(12) United States Patent
Banerjee et al.

(10) Patent No.: US 10,351,832 B2
(45) Date of Patent: *Jul. 16, 2019

(54) PHYTASES AND USES THEREOF

(71) Applicant: Fornia BioSolutions, Inc., Hayward, CA (US)

(72) Inventors: Goutami Banerjee, Hayward, CA (US); Khin Oo, Daly City, CA (US); Xiyun Zhang, Fremont, CA (US); Jie Yang, Foster City, CA (US); Yingxin Zhang, Mountain View, CA (US)

(73) Assignee: FORNIA BIOSOLUTIONS, INC., Hayward, CA (US)

( * ) Notice: Subject to any disclaimer, the term of this patent is extended or adjusted under 35 U.S.C. 154(b) by 306 days.

This patent is subject to a terminal disclaimer.

(21) Appl. No.: 15/199,001

(22) Filed: Jun. 30, 2016

(65) Prior Publication Data

US 2018/0002680 A1    Jan. 4, 2018

(51) Int. Cl.
*C12N 9/16* (2006.01)

(52) U.S. Cl.
CPC ........ *C12N 9/16* (2013.01); *C12Y 301/03026* (2013.01)

(58) Field of Classification Search
None
See application file for complete search history.

(56) References Cited

U.S. PATENT DOCUMENTS

| | | | |
|---|---|---|---|
| 6,110,719 A | 8/2000 | Kretz | |
| 6,183,740 B1 | 2/2001 | Short et al. | |
| 6,190,897 B1 | 2/2001 | Kretz | |
| 6,511,699 B1 | 1/2003 | Lei | |
| 6,720,014 B1 | 4/2004 | Short et al. | |
| 6,855,365 B2 | 2/2005 | Short et al. | |
| 6,974,690 B2 | 12/2005 | Lei | |
| 7,320,876 B2 | 1/2008 | Webel et al. | |
| 7,833,743 B2 | 11/2010 | Webel et al. | |
| 7,968,342 B2 | 6/2011 | Blattmann et al. | |
| 7,972,805 B2 | 7/2011 | Lee et al. | |
| 8,192,734 B2 | 6/2012 | Lei | |
| 8,540,984 B2 | 9/2013 | Lei | |
| 8,551,699 B2 | 10/2013 | Bussemakers et al. | |
| 9,194,010 B2 | 11/2015 | Guo et al. | |
| 2005/0281792 A1 | 12/2005 | Short et al. | |
| 2009/0155237 A1 | 6/2009 | Lei | |
| 2010/0083392 A1 | 4/2010 | Lassen et al. | |
| 2016/0264927 A1 | 9/2016 | Maisnikov et al. | |
| 2016/0289655 A1 | 10/2016 | De Maria et al. | |

FOREIGN PATENT DOCUMENTS

| | | |
|---|---|---|
| WO | WO 01/89317 A2 | 11/2001 |
| WO | WO 2015/073772 A1 | 5/2015 |
| WO | WO 2015/197871 A1 | 12/2015 |
| WO | WO 2016/078168 A1 | 5/2016 |

OTHER PUBLICATIONS

International Search Report dated Feb. 27, 2017 for Application No. PCT/US2016/040555, 15 pages.
European Search Report dated Sep. 5, 2016 for Application No. EP 16178504.3, 5 pages.
GenBank Accession No. WP_024230029.1, published Feb. 17, 2014.
GenBank Accession No. DQ51382.1, published May 4, 2006.
European Examination Report dated Sep. 18, 2018 for EP Application No. 16 178 504.3, 4 pages.
U.S. Appl. No. 15/199,057, filed Jun. 30, 2016, now U.S. Pat. No. 9,528,096.
U.S. Appl. No. 15/199,093, filed Jun. 30, 2016.
European Search Report dated Dec. 7, 2016 for Application No. EP 16178505.0, 9 pages.
Wang, Xi et al., "Enzymology and thermal stability of phytase appA mutants," RSC Advances: An International Journal to Further the Chemical Sciences, vol. 5, No. 54, Jan. 1, 2015, pp. 43863-43872.

*Primary Examiner* — Suzanne M Noakes
*Assistant Examiner* — Jae W Lee
(74) *Attorney, Agent, or Firm* — Morgan, Lewis & Bockius LLP

(57) ABSTRACT

The present invention relates to variant phytase enzymes and their use thereof.

6 Claims, 19 Drawing Sheets

Specification includes a Sequence Listing.

Figure 1

>CL00000004 G1P protein ( SEQ ID NO:1)

QSEPELKLESVVIVSRHGVRAPTKATQLMQDVTPDAWPTWPVKLGWLTPRGGELIAYLGHYQRQRLVADGLLAKKGC
PQPGQVAIIADVDERTRKTGEAFAAGLAPDCAITVHTQADTSSPDPLFNPLKTGVCQLDNANVTDAILSRAGGSIADFT
GHRQTAFRELERVLNFPQSNLCFNREKQDESCSLTQALPSELKVSADNVSLTGAVSLASMLTEIFLLQQAQGMPEPGW
GRITDSHQWNTLLSLHNAQFYLLQRTPEVARSRATPLLDLIMAALTPHPPQKQAYGVTLPTSVLFIAGHDTNLANLGGA
LELNWTLPGQPDNTPPGGELVFERWRRLSDNSQWIQVSLVFQTLQQMRDKTPLSLNTPPGEVKLTLAGCEERNAQG
MCSLAGFTQIVNEARIPACSL

MKAILIPFLSLLIPLTPQSAFA  endogeneous signal sequence protein (SEQ ID NO:2)

CL0000004 G1P DNA sequence (SEQ ID NO:3)

CAGAGTGAGCCTGAGTTGAAACTGGAATCCGTTGTCATCGTCTCTAGACATGGTGTTAGAGCACCAACCAAGGCC
ACCCAACTTATGCAAGATGTCACCCCAGACGCTTGGCCAACCTGGCCAGTCAAGCTGGGTTGGTTGACACCTAGA
GGTGGTGAGCTCATTGCTTACTTGGGTCACTACCAAAGACAGCGTCTTGTTGCCGACGGATTGTTGGCCAAGAAG
GGTTGTCCACAACCAGGTCAAGTAGCTATTATTGCTGACGTCGACGAAAGAACCCGTAAGACAGGTGAAGCCTTC
GCCGCCGGTCTTGCTCCTGACTGTGCCATTACCGTTCACACCCAAGCTGACACTTCTTCTCCAGATCCATTGTTCAAC
CCTTTGAAGACTGGTGTTTGCCAATTGGACAACGCTAACGTTACTGACGCTATCTTGTCCAGAGCTGGAGGATCCA
TTGCTGACTTCACCGGTCACAGACAGACTGCCTTCAGAGAGTTGGAAAGAGTTCTTAACTTCCCACAATCCAACTT
GTGCTTTAACCGTGAGAAGCAAGACGAATCCTGTTCCTTGACTCAAGCATTACCATCTGAGTTGAAGGTCTCCGCC
GACAACGTCTCTTTGACCGGTGCTGTCAGCTTGGCTTCCATGTTGACTGAAATCTTTCTTCTGCAACAAGCTCAAGG
TATGCCTGAGCCAGGTTGGGGTAGAATCACCGACTCTCACCAATGGAACACCTTGTTGTCCTTGCACAACGCTCAA
TTCTACTTGCTGCAGAGAACTCCAGAGGTTGCTAGATCCAGAGCCACCCCATTGTTGGACTTGATCATGGCTGCTTT
GACTCCTCACCCACCTCAAAAGCAAGCCTACGGTGTTACCTTGCCCACTTCTGTCTTGTTCATTGCCGGTCACGATA
CTAACTTGGCAAATCTCGGCGGTGCTTTGGAGTTGAACTGGACTCTTCCTGGTCAACCTGATAACACTCCACCAGG
TGGTGAGCTCGTTTTCGAAAGATGGCGTAGACTATCTGATAACTCTCAATGGATTCAGGTTTCGTTGGTCTTCCAAA
CTTTGCAGCAGATGAGAGACAAGACTCCACTGTCTTTGAACACGCCTCCAGGAGAAGTCAAATTGACCTTGGCTG
GATGTGAAGAGAGAAATGCTCAGGGTATGTGTTCCTTGGCTGGTTTCACTCAAATCGTTAACGAAGCTAGAATCCC
AGCTTGTTCCTTG

>CL00000004 EcPhytase G1P signal sequence DNA (SEQ ID NO:4)

ATGAAAGCGATCTTAATCCCATTTTTATCTCTTCTGATTCCGTTAACCCCGCAATCTGCATTCGCT

Figure 2

>CL00000430 EcPhytase G2P protein (SEQ ID NO:5)

QSEPELKLESVVIVSRHGVRAPTKATQLMQDVTPDAWPTWPVKLGWLTPRGGELVAYLGHYQRQRLVADGLLAKKG
CPQPGQVAIIADVDERTRKTGEAFAAGLAPDCAITVHTQADTSSPDPLFNPLKTGVCQLDNANVTDAILSRAGGSIADF
TQHYQTAFRELERVLNFPQSNLCFNREKQDESCSLTQALPSELKVSADNVSLTGAVSLASMLTEIFLLQQAQGMPEPG
WGRITDSHQWNTLLSLHNAQFDLLQRTPEVARSRATPLLDLIMAALTPHPPQKQAYGVTLPTSVLFIAGHDTNLANLG
GALELNWTLPGQPDNTPPGGELVFERWRRLSDNSQWIQVSLVYQTLQQMRDKTPLSLNTPPGEVKLTLPGCEERNAQ
GMCSLAGFTQIVNEARIPACSL

CL00000430 EcPhytase G2P DNA (SEQ ID NO:6)

CAGAGTGAGCCTGAGTTGAAACTGGAATCCGTTGTCATCGTCTCTAGACATGGTGTTAGAGCACCAACCAAGGCC
ACCCAACTTATGCAAGATGTCACCCCAGACGCTTGGCCAACCTGGCCAGTCAAGCTGGGTTGGTTGACACCTAGA
GGTGGTGAGCTCGTTGCTTACTTGGGTCACTACCAAAGACAGCGTCTTGTTGCCGACGGATTGTTGGCCAAGAAG
GGTTGTCCACAACCAGGTCAAGTAGCTATTATTGCTGACGTCGACGAAAGAACCCGTAAGACAGGTGAAGCCTTC
GCCGCCGGTCTTGCTCCTGACTGTGCCATTACCGTTCACACCCAAGCTGACACTTCTTCTCCAGATCCATTGTTCAAC
CCTTTGAAGACTGGTGTTTGCCAATTGGACAACGCTAACGTTACTGACGCTATCTTGTCCAGAGCTGGAGGATCCA
TTGCTGACTTCACCCAACACTACCAGACTGCCTTCAGAGAGTTGGAAAGAGTTCTTAACTTCCCACAATCCAACTTG
TGCTTTAACCGTGAGAAGCAAGACGAATCCTGTTCCTTGACTCAAGCATTACCATCTGAGTTGAAGGTCTCCGCCG
ACAACGTCTCTTTGACCGGTGCTGTCAGCTTGGCTTCCATGTTGACTGAAATCTTTCTTCTGCAACAAGCTCAAGGT
ATGCCTGAGCCAGGTTGGGGTAGAATCACCGACTCTCACCAATGGAACACCTTGTTGTCCTTGCACAACGCTCAAT
TCGACTTGCTGCAGAGAACTCCAGAGGTTGCTAGATCCAGAGCCACCCCATTGTTGGACTTGATCATGGCTGCTTT
GACTCCTCACCCACCTCAAAAGCAAGCCTACGGTGTTACCTTGCCCACTTCTGTCTTGTTCATTGCCGGTCACGATA
CTAACTTGGCAAATCTCGGCGGTGCTTTGGAGTTGAACTGGACTCTTCCTGGTCAACCTGATAACACTCCACCAGG
TGGTGAGCTCGTTTTCGAAAGATGGCGTAGACTATCTGATAACTCTCAATGGATTCAGGTTTCGTTGGTCTACCAA
ACTTTGCAGCAGATGAGAGACAAGACTCCACTGTCTTTGAACACGCCTCCAGGAGAAGTCAAATTGACCTTGCCTG
GATGTGAAGAGAGAAATGCTCAGGGTATGTGTTCCTTGGCTGGTTTCACTCAAATCGTTAACGAAGCTAGAATCCC
AGCTTGTTCCTTG

Figure 3

>CL00005023 EcPhytase G3P protein (SEQ ID NO:7)

QSEPELKLESVVIVSRHGVRAPTKATQLMQDVTPDAWPTWPVKLGWLTPRGGELVAYLGQYQRQRLVANGLLADKG
CPQPGQVAIIADVDERTRKTGEAFAAGLAPDCAITVHTQADTSRPDPLFNPLKTGVCQLDPANVTDAILSRAGGSIADFT
QHYQTAFRELERVLNFPQSNLCFNREKQDESCSLTQALPSELKVSADNVSLTGAVSLASMLTEIFLLQQAQGMPEPGW
GRITDSHQWNTLLSLHNAQFDLLQRTPEVARSRATPLLDLIMAALTPHPPQKQAYGVTLPTSVLFIAGHDTNLANLGGA
LELNWTLPGQPDNTPPGGELVFERWRRLSDNSQWIQVSLVYQTLQQMRDKTPLSLNTPPGEVKLTLPGCEERNAQG
MCSLAGFTQIVNEARIPACSL

>CL00005023 EcPhytase G3P DNA (SEQ ID NO:8)

CAGAGTGAGCCTGAGTTGAAACTGGAATCCGTTGTCATCGTCTCTAGACATGGTGTTAGAGCACCAACCAAGGCC
ACCCAACTTATGCAAGATGTCACCCCAGACGCTTGGCCAACCTGGCCAGTCAAGCTGGGTTGGTTGACACCTAGA
GGTGGTGAGCTCGTTGCTTACTTGGGTCAATACCAAAGACAGCGTCTTGTTGCCAACGGATTGTTGGCCGATAAG
GGTTGTCCACAACCAGGTCAAGTAGCTATTATTGCTGACGTCGACGAAAGAACCCGTAAGACAGGTGAAGCCTTC
GCCGCCGGTCTTGCTCCTGACTGTGCCATTACCGTTCACACCCAAGCTGACACTTCTAGACCAGATCCATTGTTCAA
CCCTTTGAAGACTGGTGTTTGCCAATTGGACCCAGCTAACGTTACTGACGCTATCTTGTCCAGAGCTGGAGGATCC
ATTGCTGACTTCACCCAACACTACCAGACTGCCTTCAGAGAGTTGGAAAGAGTTCTTAACTTCCCACAATCCAACTT
GTGCTTTAACCGTGAGAAGCAAGACGAATCCTGTTCCTTGACTCAAGCATTACCATCTGAGTTGAAGGTCTCCGCC
GACAACGTCTCTTTGACCGGTGCTGTCAGCTTGGCTTCCATGTTGACTGAAATCTTTCTTCTGCAACAAGCTCAAGG
TATGCCTGAGCCAGGTTGGGGTAGAATCACCGACTCTCACCAATGGAACACCTTGTTGTCCTTGCACAACGCTCAA
TTCGACTTGCTGCAGAGAACTCCAGAGGTTGCTAGATCCAGAGCCACCCCATTGTTGGACTTGATCATGGCTGCTT
TGACTCCTCACCCACCTCAAAAGCAAGCCTACGGTGTTACCTTGCCCACTTCTGTCTTGTTCATTGCCGGTCACGAT
ACTAACTTGGCAAATCTCGGCGGTGCTTTGGAGTTGAACTGGACTCTTCCTGGTCAACCTGATAACACTCCACCAG
GTGGTGAGCTCGTTTTCGAAAGATGGCGTAGACTATCTGATAACTCTCAATGGATTCAGGTTTCGTTGGTCTACCA
AACTTTGCAGCAGATGAGAGACAAGACTCCACTGTCTTTGAACACGCCTCCAGGAGAAGTCAAATTGACCTTGCCT
GGATGTGAAGAGAGAAATGCTCAGGGTATGTGTTCCTTGGCTGGTTTCACTCAAATCGTTAACGAAGCTAGAATC
CCAGCTTGTTCCTTG

Figure 4

>CL00014818 EcPhytase G4P protein (SEQ ID NO:9)

QSEPELKLESVVIVSRHGVRAPTKATQLMQDVTPDAWPTWPVKLGWLTPRGGELVAYLGQYQRQRLVANGLLADKG
CPQPGQVAIIADVDERTRKTGEAFAAGLAPDCAITVHTQADTSRPDPLFNPLKTGVCQLDPAAVTDAILSRAGGSIADFT
QHYQTAFRELERVLNFPQSKLCFNREKQNESCSLTQALPSELKVSADNVSLTGAVSLASMLTEIFLLQQAQGMPEPGW
GRITDSHQWNTLLSLHNAQFDLLQRTPEVARSRATPLLDLIMAALTPHPPQKQAYGVTLPTSVLFIAGHDTNLANLGGA
LELNWTLPGQPDNTPPGGELVFERWRRLSDNSQWIQVSLVYQTLQQMRDKTPLSLNTPPGEVKLTLPGCEERNAQG
MCSLAGFTQIVNDARIPACSL

>CL00014818 EcPhytase G4P DNA (SEQ ID NO:10)

CAGAGTGAGCCTGAGTTGAAACTGGAATCCGTTGTCATCGTCTCTAGACATGGTGTTAGAGCACCAACCAAGGCC
ACCCAACTTATGCAAGATGTCACCCCAGACGCTTGGCCAACCTGGCCAGTCAAGCTGGGTTGGTTGACACCTAGA
GGTGGTGAGCTCGTTGCTTACTTGGGTCAATACCAAAGACAGCGTCTTGTTGCCAACGGATTGTTGGCCGATAAG
GGTTGTCCACAACCAGGTCAAGTAGCTATTATTGCTGACGTCGACGAAAGAACCCGTAAGACAGGTGAAGCCTTC
GCCGCCGGTCTTGCTCCTGACTGTGCCATTACCGTTCACACCCAAGCTGACACTTCTAGACCAGATCCATTGTTCAA
CCCTTTGAAGACTGGTGTTTGCCAATTGGACCCAGCTGCTGTTACTGACGCTATCTTGTCCAGAGCTGGAGGATCC
ATTGCTGACTTCACCCAACACTACCAGACTGCCTTCAGAGAGTTGGAAAGAGTTCTTAACTTCCCACAATCCAAGTT
GTGCTTTAACCGTGAGAAGCAAAACGAATCCTGTTCCTTGACTCAAGCATTACCATCTGAGTTGAAGGTCTCCGCC
GACAACGTCTCTTTGACCGGTGCTGTCAGCTTGGCTTCCATGTTGACTGAAATCTTTCTTCTGCAACAAGCTCAAGG
TATGCCTGAGCCAGGTTGGGGTAGAATCACCGACTCTCACCAATGGAACACCTTGTTGTCCTTGCACAACGCTCAA
TTCGACTTGCTGCAGAGAACTCCAGAGGTTGCTAGATCCAGAGCCACCCCATTGTTGGACTTGATCATGGCTGCTT
TGACTCCTCACCCACCTCAAAAGCAAGCCTACGGTGTTACCTTGCCCACTTCTGTCTTGTTCATTGCCGGTCACGAT
ACTAACTTGGCAAATCTCGGCGGTGCTTTGGAGTTGAACTGGACTCTTCCTGGTCAACCTGATAACACTCCACCAG
GTGGTGAGCTCGTTTTCGAAAGATGGCGTAGACTATCTGATAACTCTCAATGGATTCAGGTTTCGTTGGTCTACCA
AACTTTGCAGCAGATGAGAGACAAGACTCCACTGTCTTTGAACACGCCTCCAGGAGAAGTCAAATTGACCTTGCCT
GGATGTGAAGAGAGAAATGCTCAGGGTATGTGTTCCTTGGCTGGTTTCACTCAAATCGTTAACGATGCTAGAATCC
CAGCTTGTTCCTTG

Figure 5A

| Colony Tracking Number | pH Tolerance RT, pH5.5 | | pH/Temp Tolerance 58C, pH5.5 | | Specific Activity RT, pH4.5 | | Temp Tolerance 58C, pH4.5 | | AA Mutations w.r.t. G1P (CL0004) |
|---|---|---|---|---|---|---|---|---|---|
| | PF AVG | PF STD | PF AVG | PF STD | PF AVG | PF STD | PF AVG | PF STD | |
| CL00000004 | 1.00 | 0.07 | 1.00 | 0.28 | 1.00 | 0.08 | 1.00 | 0.09 | |
| CL00000605 | 1.00 | 0.14 | 1.30 | 0.04 | 1.20 | 0.06 | 1.15 | 0.02 | T141E/ |
| CL00000624 | 1.10 | 0.02 | 0.40 | 0.03 | 1.10 | 0.01 | 0.93 | 0.01 | T141G/ |
| CL00000625 | 1.10 | 0.06 | 1.80 | 0.02 | 1.10 | 0.01 | 1.03 | 0.02 | S146R/ |
| CL00000647 | 1.10 | 0.04 | 1.60 | 0.11 | 1.60 | 0.02 | 1.23 | 0.01 | T141A/ |
| CL00000663 | 1.20 | 0.04 | 1.90 | 0.04 | 1.30 | 0.18 | 1.21 | 0.05 | N137S/ |
| CL00000690 | 1.00 | 0.12 | 1.90 | 0.08 | 1.30 | 0.17 | 1.20 | 0.05 | G157N/ |
| CL00000715 | 1.10 | 0.04 | 1.90 | 0.02 | 1.50 | 0.02 | 1.20 | 0.01 | T141R/ |
| CL00000716 | 1.00 | 0.09 | 1.80 | 0.02 | 1.10 | 0.02 | 1.14 | 0.03 | G157L/ |
| CL00000721 | 1.20 | 0.07 | 1.90 | 0.06 | 1.30 | 0.21 | 1.20 | 0.03 | G157R/ |
| CL00000774 | 1.00 | 0.03 | 1.60 | 0.03 | 1.10 | 0.02 | 1.23 | 0.01 | G157A/ |
| CL00000835 | 1.10 | 0.01 | 1.70 | 0.02 | 1.10 | 0.04 | 1.15 | 0.06 | N137P/ |
| CL00000872 | 1.00 | 0.03 | 1.50 | 0.05 | 1.30 | 0.08 | 1.21 | 0.01 | Q1S/ |
| CL00001018 | 1.00 | 0.01 | 1.00 | 0.14 | 1.10 | 0.03 | 1.02 | 0.05 | Q1V/ |
| CL00001019 | 1.10 | 0.06 | 1.00 | 0.02 | 1.10 | 0.01 | 1.15 | 0.02 | A36K/ |
| CL00001052 | 1.10 | 0.02 | 1.60 | 0.02 | 1.40 | 0.04 | 1.14 | 0.03 | T39D/ |
| CL00001057 | 0.90 | 0.14 | 0.80 | 0.14 | 1.00 | 0.03 | 0.94 | 0.05 | Q1N/ |
| CL00001132 | 1.00 | 0.15 | 1.50 | 0.09 | 1.10 | 0.02 | 1.04 | 0.03 | S120R/ |
| CL00001154 | 1.00 | 0.17 | 1.30 | 0.43 | 1.40 | 0.20 | 1.11 | 0.14 | T118R/ |
| CL00001170 | 1.10 | 0.07 | 1.00 | 0.09 | 1.10 | 0.01 | 0.97 | 0.05 | A109D/ |
| CL00001177 | 1.20 | 0.01 | 0.80 | 0.08 | 1.00 | 0.01 | 1.00 | 0.03 | Q79L/ |
| CL00001243 | 1.00 | 0.08 | 1.40 | 0.21 | 1.10 | 0.04 | 1.01 | 0.01 | A73D/ |
| CL00001244 | 0.90 | 0.07 | 0.90 | 0.03 | 1.00 | 0.01 | 1.02 | 0.04 | Q79R/ |
| CL00001286 | 1.00 | 0.01 | 0.50 | 0.04 | 1.10 | 0.01 | 1.04 | 0.03 | T118S/ |
| CL00001294 | 1.10 | 0.12 | 0.40 | 0.06 | 1.00 | 0.03 | 1.09 | 0.05 | A116Y/ |
| CL00001305 | 1.00 | 0.07 | 0.70 | 0.02 | 1.10 | 0.01 | 0.97 | 0.02 | T111S/ |

Figure 5B

| Colony Tracking Number | pH Tolerance RT, pH5.5 | | pH/Temp Tolerance 58C, pH5.5 | | Specific Activity RT, pH4.5 | | Temp Tolerance 58C, pH4.5 | | AA Mutations w.r.t. G1P (CL0004) |
|---|---|---|---|---|---|---|---|---|---|
| | PF AVG | PF STD | PF AVG | PF STD | PF AVG | PF STD | PF AVG | PF STD | |
| CL00001316 | 1.00 | 0.01 | 1.20 | 0.11 | 1.10 | 0.04 | 1.12 | 0.13 | T111D/ |
| CL00001342 | 1.00 | 0.02 | 1.30 | 0.10 | 1.20 | 0.02 | 1.22 | 0.03 | A109E/ |
| CL00001347 | 1.00 | 0.03 | 0.90 | 0.08 | 1.10 | 0.00 | 0.93 | 0.02 | A109G/ |
| CL00001352 | 1.10 | 0.01 | 0.70 | 0.11 | 1.00 | 0.01 | 1.04 | 0.02 | A116P/ |
| CL00001353 | 1.00 | 0.02 | 0.40 | 0.04 | 1.00 | 0.01 | 0.94 | 0.00 | A138P/ |
| CL00001354 | 1.00 | 0.02 | 0.60 | 0.11 | 1.00 | 0.02 | 0.99 | 0.03 | Q79A/ |
| CL00001366 | 1.10 | 0.03 | 1.70 | 0.02 | 1.00 | 0.04 | 1.01 | 0.02 | K74D/ |
| CL00001389 | 1.00 | 0.14 | 1.70 | 0.07 | 1.20 | 0.16 | 1.14 | 0.04 | H60Q/ |
| CL00001394 | 1.00 | 0.11 | 1.70 | 0.07 | 1.00 | 0.01 | 0.97 | 0.04 | K74P/ |
| CL00001416 | 1.10 | 0.08 | 1.50 | 0.24 | 1.40 | 0.18 | 1.17 | 0.03 | H60S/ |
| CL00001428 | 1.10 | 0.02 | 0.90 | 0.06 | 1.30 | 0.13 | 1.25 | 0.03 | A116R/ |
| CL00001434 | 1.00 | 0.02 | 0.60 | 0.06 | 1.00 | 0.02 | 0.95 | 0.03 | K74L/ |
| CL00001446 | 1.10 | 0.04 | 1.40 | 0.11 | 1.10 | 0.02 | 1.13 | 0.03 | T111Q/ |
| CL00001462 | 1.00 | 0.01 | 0.70 | 0.04 | 1.00 | 0.03 | 1.00 | 0.06 | A73E/ |
| CL00001500 | 1.00 | 0.04 | 0.80 | 0.13 | 1.00 | 0.01 | 1.04 | 0.02 | Q79G/ |
| CL00001522 | 1.10 | 0.06 | 1.60 | 0.16 | 1.30 | 0.14 | 1.18 | 0.02 | A138V/ |
| CL00001543 | 1.10 | 0.03 | 1.00 | 0.15 | 1.40 | 0.10 | 1.16 | 0.07 | A109F/ |
| CL00001566 | 1.00 | 0.02 | 0.70 | 0.06 | 1.10 | 0.01 | 1.00 | 0.02 | A116S/ |
| CL00001591 | 1.10 | 0.11 | 1.40 | 0.10 | 1.00 | 0.01 | 1.05 | 0.06 | A109P/ |
| CL00001592 | 1.10 | 0.03 | 0.70 | 0.11 | 1.00 | 0.02 | 1.08 | 0.02 | Q79F/ |
| CL00001593 | 1.00 | 0.04 | 1.00 | 0.14 | 1.00 | 0.01 | 1.18 | 0.04 | A138H/ |
| CL00001608 | 1.20 | 0.02 | 1.80 | 0.00 | 1.40 | 0.03 | 1.21 | 0.02 | D69N/ |
| CL00005866 | 1.18 | 0.02 | 1.36 | 0.10 | | | | | A138D/ |
| CL00005937 | 1.16 | 0.00 | 0.99 | 0.09 | | | | | D185L/ |
| CL00006019 | 1.18 | 0.01 | 1.22 | 0.03 | | | | | E186V/ |
| CL00006048 | 1.18 | 0.02 | 1.25 | 0.04 | | | | | E186A/ |

Figure 5C

| Colony Tracking Number | pH Tolerance | | pH/Temp Tolerance | | Specific Activity | | Temp Tolerance | | AA Mutations w.r.t. G1P (CL0004) |
|---|---|---|---|---|---|---|---|---|---|
| | RT, pH5.5 | | 58C, pH5.5 | | RT, pH4.5 | | 58C, pH4.5 | | |
| | PF AVG | PF STD | PF AVG | PF STD | PF AVG | PF STD | PF AVG | PF STD | |
| CL00005049 | 1.17 | 0.03 | 1.96 | 0.04 | | | | | N139H/K183R |
| CL00006063 | 1.15 | 0.02 | 1.09 | 0.02 | | | | | N180T/ |
| CL00006069 | 1.11 | 0.04 | 0.86 | 0.02 | | | | | Q184S/ |
| CL00006138 | 1.11 | 0.00 | 1.97 | 0.02 | | | | | N176K/ |
| CL00006139 | 1.21 | 0.00 | 0.98 | 0.06 | | | | | N139P/ |
| CL00006142 | 1.19 | 0.00 | 1.65 | 0.03 | | | | | N180E/ |
| CL00006253 | 1.18 | 0.00 | 2.08 | 0.06 | | | | | N139A/ |
| CL00006276 | 1.12 | 0.01 | 1.71 | 0.02 | | | | | D185N/ |
| CL00006331 | 1.17 | 0.04 | 1.81 | 0.16 | | | | | N139H/ |
| CL00006385 | 1.13 | 0.00 | 0.99 | 0.04 | | | | | M276V/ |
| CL00006672 | 1.19 | 0.01 | 1.71 | 0.00 | | | | | H282N/ |
| CL00006712 | 1.15 | 0.01 | 0.82 | 0.01 | | | | | T245E/ |
| CL00006819 | 1.07 | 0.00 | 1.95 | 0.12 | | | | | H282P/ |
| CL00006870 | 1.10 | 0.00 | 0.87 | 0.06 | | | | | N369P/ |
| CL00006874 | 1.19 | 0.00 | 1.38 | 0.11 | | | | | R385S/ |
| CL00006875 | 1.10 | 0.02 | 2.33 | 0.05 | | | | | E402R/ |
| CL00006917 | 1.08 | 0.01 | 2.44 | 0.05 | | | | | E315G/ |
| CL00007021 | 1.07 | 0.02 | 1.16 | 0.05 | | | | | L341Y/ |
| CL00007061 | 1.07 | 0.01 | 1.53 | 0.07 | | | | | E383S/ |
| CL00007067 | 1.07 | 0.00 | 1.55 | 0.04 | | | | | R385V/ |
| CL00007078 | 1.08 | 0.00 | 1.39 | 0.08 | | | | | E402T/ |
| CL00007081 | 1.18 | 0.02 | 1.80 | 0.03 | | | | | R385T/ |
| CL00007094 | 1.07 | 0.00 | 1.38 | 0.00 | | | | | L341V/ |
| CL00007097 | 1.10 | 0.04 | 1.25 | 0.07 | | | | | E315S/ |
| CL00007111 | 1.05 | 0.01 | 1.24 | 0.00 | | | | | E402D/ |
| CL00007118 | 1.15 | 0.03 | 0.85 | 0.00 | | | | | E402P/ |

Figure 5D

| Colony Tracking Number | pH Tolerance RT, pH5.5 | | pH/Temp Tolerance 58C, pH5.5 | | Specific Activity RT, pH4.5 | | Temp Tolerance 58C, pH4.5 | | AA Mutations w.r.t. G1P (CL0004) |
|---|---|---|---|---|---|---|---|---|---|
| | PF AVG | PF STD | PF AVG | PF STD | PF AVG | PF STD | PF AVG | PF STD | |
| CL00007134 | 1.06 | 0.01 | 1.22 | 0.02 | | | | | A288E/ |
| CL00007137 | 1.11 | 0.02 | 2.36 | 0.03 | | | | | E402N/ |
| CL00007144 | 1.16 | 0.00 | 2.45 | 0.07 | | | | | A288R/ |
| CL00007204 | 1.07 | 0.00 | 1.22 | 0.08 | | | | | K363A/ |
| CL00007207 | 1.20 | 0.01 | 1.71 | 0.05 | | | | | A380R/ |
| CL00007238 | 1.25 | 0.00 | 0.67 | 0.07 | | | | | T370P/ |
| CL00007303 | 1.06 | 0.01 | 1.16 | 0.00 | | | | | A288V/ |
| CL00007310 | 1.06 | 0.00 | 1.69 | 0.04 | | | | | A380T/ |
| CL00007343 | 1.08 | 0.00 | 1.64 | 0.10 | | | | | K363L/ |

Figure 6

| Colony Tracking Number | pH Tolerance RT, pH5.5 | | pH/Temp Tolerance 66C, pH5.5 | | Specific Activity RT, pH4.5 | | Temp Tolerance 66C, pH4.5 | | AA Mutations w.r.t. G1P (CL0004) |
|---|---|---|---|---|---|---|---|---|---|
| | PF AVG | PF STD | PF AVG | PF STD | PF AVG | PF STD | PF AVG | PF STD | |
| CL00000004 | 1.00 | 0.10 | 1.00 | 0.17 | 1.00 | 0.06 | 1.00 | 0.24 | |
| CL00000108 | 1.24 | 0.01 | 4.26 | 1.30 | 1.64 | 0.03 | 3.95 | 0.16 | R159Y/Y255D/V291I/V297L/G311S/ |
| CL00000144 | 1.24 | 0.01 | 3.93 | 1.31 | 1.62 | 0.03 | 3.70 | 0.61 | I55V/Y255D/G311S/F354Y/ |
| CL00000157 | 1.23 | 0.01 | 3.47 | 0.97 | 1.52 | 0.04 | 2.37 | 0.19 | G233A/Y255D/V291I/ |
| CL00000165 | 0.16 | 0.00 | 0.09 | 0.06 | 0.22 | 0.01 | 0.07 | 0.02 | I85V/G157Q/V291I/V297L/G311S/F354Y/ |
| CL00000187 | 1.20 | 0.06 | 2.63 | 1.97 | 1.38 | 0.20 | 2.63 | 1.12 | A101L/Y255D/ |
| CL00000216 | 1.24 | 0.01 | 2.28 | 0.16 | 1.48 | 0.03 | 2.43 | 0.14 | I55V/I85V/Y255D/V291I/ |
| CL00000223 | 1.07 | 0.08 | 1.31 | 0.33 | 1.11 | 0.04 | 0.92 | 0.19 | I55V/F354Y/ |
| CL00000231 | 1.24 | 0.01 | 5.37 | 0.79 | 1.39 | 0.04 | 2.26 | 0.09 | I55V/I85V/Y255D/V291I/F354Y/ |
| CL00000239 | 1.25 | 0.02 | 5.61 | 1.66 | 1.56 | 0.02 | 5.15 | 0.17 | R159Y/Y255D/V291I/ |
| CL00000264 | 1.02 | 0.07 | 1.27 | 0.22 | 1.08 | 0.06 | 1.32 | 0.38 | A101L/R159Y/S189T/T295I/F354Y/ |
| CL00000266 | 1.16 | 0.01 | 2.27 | 0.24 | 1.14 | 0.03 | 3.77 | 0.04 | Q30K/I85V/Y255D/A380P/ |
| CL00000313 | 1.24 | 0.00 | 3.66 | 0.30 | 1.21 | 0.03 | 3.31 | 0.32 | G157Q/R159Y/ |
| CL00000317 | 1.23 | 0.01 | 4.33 | 1.33 | 1.48 | 0.08 | 7.40 | 1.33 | I55V/I85V/S189T/G233A/Y255D/F354Y/A380P/ |
| CL00000360 | 1.05 | 0.05 | 1.43 | 0.63 | 0.99 | 0.01 | 0.80 | 0.14 | I55V/I85V/S189T/V297L/G311S/ |
| CL00000374 | 1.10 | 0.03 | 2.09 | 0.28 | 1.01 | 0.03 | 0.87 | 0.11 | F354Y/ |
| CL00000387 | 1.12 | 0.07 | 2.36 | 0.33 | 1.08 | 0.05 | 1.15 | 0.22 | I55V/I85V/A101L/G157Q/G233A/F354Y/ |
| CL00000391 | 1.25 | 0.01 | 3.50 | 0.77 | 1.54 | 0.01 | 5.52 | 0.48 | I55V/G157Q/Y255D/V291I/V297L/F354Y/ |
| CL00000408 | 1.25 | 0.00 | 2.65 | 0.61 | 1.31 | 0.06 | 3.03 | 0.40 | R159Y/ |
| CL00000416 | 0.54 | 0.09 | 0.53 | 0.19 | 0.75 | 0.08 | 0.52 | 0.01 | I55V/ |
| CL00000420 | 1.77 | 0.01 | 4.60 | 1.44 | 1.44 | 0.11 | 2.64 | 0.66 | Y255D/ |
| CL00000430 | 1.08 | 0.02 | 19.55 | 7.90 | 1.11 | 0.02 | 11.64 | 0.24 | (G2P) I55V/G157Q/R159Y/Y255D/F354Y/A380P/ |
| CL00000432 | 1.25 | 0.01 | 5.28 | 0.30 | 1.47 | 0.02 | 8.64 | 0.54 | I55V/R159Y/Y255D/V297L/A380P/ |
| CL00000433 | 0.64 | 0.03 | 0.79 | 0.13 | 0.90 | 0.04 | 0.63 | 0.10 | I55V/I85V/G157Q/G233A/Y255D/V297L/F354Y/ |
| CL00000528 | 1.27 | 0.00 | 4.96 | 0.26 | 1.31 | 0.04 | 2.24 | 0.63 | I55V/A101L/G157Q/Y255D/V297L/ |
| CL00000565 | 1.24 | 0.01 | 3.02 | 0.53 | 1.50 | 0.01 | 3.64 | 0.71 | I55V/A101L/G157Q/Y255D/F354Y/ |
| CL00000573 | 0.13 | 0.02 | 0.09 | 0.20 | 0.19 | 0.00 | 0.09 | 0.07 | I55V/V291I/V297L/ |
| CL00000588 | 1.25 | 0.01 | 6.66 | 1.25 | 1.39 | 0.06 | 2.65 | 0.09 | I55V/I85V/A101L/R159Y/S189T/Y255D/F354Y/ |

Figure 7A

| Colony Tracking Number | pH Tolerance RT, pH5.5 | | pH/Temp Tolerance 66C, pH5.5 | | AA Mutations w.r.t. G2P (CL0430) |
|---|---|---|---|---|---|
| | PF AVG | PF STD | PF AVG | PF STD | |
| CL000004930 | 1.00 | 0.03 | 1.00 | 0.07 | |
| CL000004927 | 1.25 | 0.03 | 1.97 | 0.05 | H60S/D69N/T111D/N137P/ |
| CL000004928 | 1.25 | 0.11 | 1.67 | 0.16 | T39D/N137S/T141A/ |
| CL000004930 | 1.09 | 0.07 | 1.66 | 0.03 | H60Q/D69N/N137P/A138V/ |
| CL000004936 | 1.27 | 0.08 | 1.89 | 0.03 | T39D/D69N/K74D/N137P/A138V/T141E/ |
| CL000004938 | 1.24 | 0.13 | 1.41 | 0.06 | K74D/T111D/T141A/ |
| CL000004940 | 1.06 | 0.03 | 1.16 | 0.03 | N137S/A138V/T141E/ |
| CL000004948 | 1.21 | 0.06 | 1.81 | 0.01 | H60Q/K74P/N137S/T141E/ |
| CL000004951 | 1.25 | 0.03 | 1.8 | 0.07 | D69N/K74P/ |
| CL000004954 | 1.32 | 0.05 | 1.79 | 0.02 | H60Q/K74P/ |
| CL000004962 | 1.12 | 0.02 | 1.41 | 0.06 | T39D/T111D/S120R/ |
| CL000004963 | 1.1 | 0.01 | 1.7 | 0.05 | T39D/H60Q/K74D/T111D/S120R/ |
| CL000004967 | 1.28 | 0.13 | 1.7 | 0.06 | T39D/D69N/ |
| CL000004970 | 1.17 | 0.04 | 1.76 | 0.02 | D69N/K74D/ |
| CL000004976 | 1.25 | 0.03 | 1.84 | 0.02 | T39D/H60Q/D69N/N137S/A138V/ |
| CL000004977 | 1.18 | 0.06 | 1.63 | 0.04 | T39D/K74D/Q157A/ |
| CL000004979 | 1.16 | 0.04 | 1.78 | 0.02 | T39D/H60Q/K74D/N137P/T141A/ |
| CL000004981 | 1.12 | 0.04 | 1.72 | 0.07 | K74D/ |
| CL000004983 | 1.28 | 0.05 | 1.82 | 0.03 | T39D/D69N/N137P/T141E/Q157A/ |
| CL000004990 | 1.28 | 0.07 | 1.82 | 0.08 | S120R/N137P/A138V/ |
| CL000004994 | 1.38 | 0.02 | 1.75 | 0.05 | T39D/H60Q/ |
| CL000004998 | 1.2 | 0.02 | 1.53 | 0.07 | K74D/T141A/ |
| CL000005001 | 1.45 | 0.05 | 1.83 | 0.04 | K74P/ |
| CL000005002 | 1.39 | 0.09 | 1.81 | 0.03 | N137P/A138V/ |
| CL000005012 | 1.27 | 0.07 | 1.75 | 0.11 | H60Q/D69N/ |
| CL000005013 | 1.14 | 0.02 | 1.77 | 0.07 | T39D/D69N/K74D/ |
| CL000005023 | 1.22 | 0.02 | 1.85 | 0.03 | (G3P)/H60Q/D69N/K74D/S120R/N137P/ |

Figure 7B

| Colony Tracking Number | pH Tolerance RT, pH5.5 | | pH/Temp Tolerance 66C, pH5.5 | | AA Mutations w.r.t. G2P (CL0430) |
|---|---|---|---|---|---|
| | PF AVG | PF STD | PF AVG | PF STD | |
| CL00005041 | 1.33 | 0.04 | 1.69 | 0.03 | D69N/N137P/A138V/T141E/ |
| CL00005054 | 1.23 | 0.06 | 1.72 | 0.03 | T39D/D69N/K74P/T111D/S120R/T141A/ |
| CL00005064 | 1.02 | 0.03 | 1.27 | 0.02 | N137P/T141A/ |
| CL00005080 | 1.14 | 0.05 | 1.76 | 0.01 | N137P/A138V/T141E/ |
| CL00005081 | 1.11 | 0.03 | 1.55 | 0.04 | T39D/K74D/ |
| CL00005083 | 1.13 | 0.04 | 1.26 | 0.01 | T39D/H60S/T111D/S120R/ |
| CL00005086 | 1.19 | 0.09 | 1.63 | 0.05 | T39D/H60S/D69N/S120R/N137S/T141A/ |
| CL00005181 | 1.14 | 0.03 | 1.45 | 0.04 | H60Q/N137P/A138V/T141A/ |
| CL00005230 | 1.13 | 0.01 | 1.13 | 0.05 | Q157L/ |
| CL00005241 | 1.02 | 0.02 | 1.34 | 0.08 | S120R/N137P/ |
| CL00005248 | 1.24 | 0.14 | 1.26 | 0.02 | H60Q/ |
| CL00005267 | 1.23 | 0.04 | 1.21 | 0.04 | S120R/ |
| CL00005313 | 1.1 | 0.01 | 1.2 | 0.06 | S120R/N137S/A138V/Q157L/ |
| CL00005382 | 0.89 | 0.04 | 0.35 | 0.02 | H60S/K74Y/S120R/A138V/ |
| CL00005417 | 1.23 | 0.14 | 1.37 | 0.04 | T39D/D69N/S120R/T141A/ |
| CL00005517 | 1.2 | 0.06 | 1.27 | 0.01 | H60S/ |
| CL00005529 | 1.27 | 0.02 | 1.48 | 0.04 | T39D/S120R/ |
| CL00005540 | 1.4 | 0.04 | 1.49 | 0.08 | T39D/ |
| CL00005550 | 1.19 | 0.09 | 1.43 | 0.06 | H60S/K74D/ |
| CL00005552 | 1.38 | 0.06 | 1.49 | 0.09 | T39D/T111D/ |
| CL00005563 | 1.12 | 0.04 | 1.35 | 0.02 | T39D/H60S/ |
| CL00005570 | 1.12 | 0.02 | 1.5 | 0.04 | T39D/K74D/T141E/ |
| CL00005572 | 0.98 | 0.01 | 1.28 | 0.01 | K74D/T111D/T141E/Q157N/ |
| CL00005573 | 1.38 | 0.06 | 1.77 | 0.03 | H60S/K74D/T111D/S120R/T141E/Q157N/ |
| CL00005579 | 1.09 | 0.05 | 1.55 | 0.08 | T39D/K74D/S120R/T141E/ |
| CL00005587 | 1.16 | 0.04 | 1.26 | 0.03 | T141E/ |
| CL00005590 | 1.1 | 0.04 | 1.51 | 0.08 | K74D/S120R/Q157N/ |

Figure 7C

| Colony Tracking Number | pH Tolerance RT, pH5.5 | | pH/Temp Tolerance 66C, pH5.5 | | AA Mutations w.r.t. G2P (CL0430) |
|---|---|---|---|---|---|
| | PF AVG | PF STD | PF AVG | PF STD | |
| CL00005621 | 1.38 | 0.16 | 1.74 | 0.05 | K74D/S120R/ |
| CL00005625 | 1.15 | 0.07 | 1.25 | 0.01 | T111D/S120R/T141E/ |
| CL00005677 | 1.11 | 0.03 | 0.4 | 0 | H60S/R65H/ |

Figure 8

| Colony Tracking Number | pH/Temp Tolerance 70.2C, pH5.5 PF | AA Mutations w.r.t. G3P (CL5023) |
|---|---|---|
| CL00005023 | 1.00 | |
| CL00014818 | 4.04 | (G4P) N139A/N176K/D185N/E402D/ |
| CL00014748 | 3.19 | N176K/D185N/H282N/R385T/ |
| CL00015018 | 3.11 | N176K/D185N/K363A/R385T/E402T/ |
| CL00015007 | 2.89 | N139H/N176K/D185N/H282N/A288R/E315G/R385T/ |
| CL00015507 | 2.75 | N139A/N176K/A288R/E315G/ |
| CL00014749 | 1.89 | D185N/H282N/A288R/E315G/ |

SP: AA 1-22
Catalytic Domain: AA 29-374
Catalytic Residues:      H39 (Nucleophile), D326 (Proton donor)
Substrate Binding Residues: R38, R114, R289

```
                 1                                                  50
CL00000004    MKAILIPFLS LLIPLTPQSA FAQSEPELKL ESVVIVSRHG VRAPTKATQL
CL00000430    MKAILIPFLS LLIPLTPQSA FAQSEPELKL ESVVIVSRHG VRAPTKATQL
CL00005023    MKAILIPFLS LLIPLTPQSA FAQSEPELKL ESVVIVSRHG VRAPTKATQL
CL00014818    MKAILIPFLS LLIPLTPQSA FAQSEPELKL ESVVIVSRHG VRAPTKATQL 51                                                 100
CL00000004    MQDVTPDAWP TWPVKLGWLT PRGGELIAYL GHYQRQRLVA DGLLAKKGCP
CL00000430    MQDVTPDAWP TWPVKLGWLT PRGGELVAYL GHYQRQRLVA DGLLAKKGCP
CL00005023    MQDVTPDAWP TWPVKLGWLT PRGGELVAYL GQYQRQRLVA NGLLADKGCP
CL00014818    MQDVTPDAWP TWPVKLGWLT PRGGELVAYL GQYQRQRLVA NGLLADKGCP 101                                                150
CL00000004    QPGQVAIIAD VDERTRKTGE AFAAGLAPDC AITVHTQADT SSPDPLFNPL
CL00000430    QPGQVAIIAD VDERTRKTGE AFAAGLAPDC AITVHTQADT SSPDPLFNPL
CL00005023    QPGQVAIIAD VDERTRKTGE AFAAGLAPDC AITVHTQADT SRPDPLFNPL
CL00014818    QPGQVAIIAD VDERTRKTGE AFAAGLAPDC AITVHTQADT SRPDPLFNPL 151                                                200
CL00000004    KTGVCQLDNA NVTDAILSRA GGSIADFTGH RQTAFRELER VLNFPQSNLC
CL00000430    KTGVCQLDNA NVTDAILSRA GGSIADFTQH YQTAFRELER VLNFPQSNLC
CL00005023    KTGVCQLDPA NVTDAILSRA GGSIADFTQH YQTAFRELER VLNFPQSNLC
CL00014818    KTGVCQLDPA AVTDAILSRA GGSIADFTQH YQTAFRELER VLNFPQSKLC 201                                                250
CL00000004    FNREKQDESC SLTQALPSEL KVSADNVSLT GAVSLASMLT EIFLLQQAQG
CL00000430    FNREKQDESC SLTQALPSEL KVSADNVSLT GAVSLASMLT EIFLLQQAQG
CL00005023    FNREKQDESC SLTQALPSEL KVSADNVSLT GAVSLASMLT EIFLLQQAQG
CL00014818    FNREKQNESC SLTQALPSEL KVSADNVSLT GAVSLASMLT EIFLLQQAQG 251                                                300
CL00000004    MPEPGWGRIT DSHQWNTLLS LHNAQFYLLQ RTPEVARSRA TPLLDLIMAA
CL00000430    MPEPGWGRIT DSHQWNTLLS LHNAQFDLLQ RTPEVARSRA TPLLDLIMAA
CL00005023    MPEPGWGRIT DSHQWNTLLS LHNAQFDLLQ RTPEVARSRA TPLLDLIMAA
CL00014818    MPEPGWGRIT DSHQWNTLLS LHNAQFDLLQ RTPEVARSRA TPLLDLIMAA 301                                                350
```

Figure 9B

```
             LTPHPPQKQA  YGVTLPTSVL  FIAGHDTNLA  NLGGALELNW  TLPGQPDNTP
CL00000004   LTPHPPQKQA  YGVTLPTSVL  FIAGHDTNLA  NLGGALELNW  TLPGQPDNTP
CL00000430   LTPHPPQKQA  YGVTLPTSVL  FIAGHDTNLA  NLGGALELNW  TLPGQPDNTP
CL00005023   LTPHPPQKQA  YGVTLPTSVL  FIAGHDTNLA  NLGGALELNW  TLPGQPDNTP
CL00014818   LTPHPPQKQA  YGVTLPTSVL  FIAGHDTNLA  NLGGALELNW  TLPGQPDNTP 351                                                   400
CL00000004   PGGELVFERW  RRLSDNSQWI  QVSLVFQTLQ  QMRDKTPLSL  NTPPGEVKLT
CL00000430   PGGELVFERW  RRLSDNSQWI  QVSLVYQTLQ  QMRDKTPLSL  NTPPGEVKLT
CL00005023   PGGELVFERW  RRLSDNSQWI  QVSLVYQTLQ  QMRDKTPLSL  NTPPGEVKLT
CL00014818   PGGELVFERW  RRLSDNSQWI  QVSLVYQTLQ  QMRDKTPLSL  NTPPGEVKLT 401                           432
CL00000004   LAGCEERNAQ  GMCSLAGFTQ  IVNEARIPAC  SL
CL00000430   LPGCEERNAQ  GMCSLAGFTQ  IVNEARIPAC  SL
CL00005023   LPGCEERNAQ  GMCSLAGFTQ  IVNEARIPAC  SL
CL00014818   LPGCEERNAQ  GMCSLAGFTQ  IVNDARIPAC  SL
```

Figure 11A

| Position (mature numbering) | Wild type residue | Particular Variants |
|---|---|---|
| 1 | Glutamine (Q) | S, V, N |
| 30 | Q | K |
| 36 | A | K |
| 39 | T | D |
| 55 | I | V |
| 60 | H | S, Q |
| 65 | R | H |
| 69 | D | N |
| 73 | A | D, E |
| 74 | K | D, P, L |
| 79 | Q | L, R, A, G, F |
| 85 | I | V |
| 101 | A | L |
| 109 | A | D, E, G, F, P |
| 111 | T | S, D, Q |
| 116 | A | Y, P, R, S |
| 118 | T | R, S |
| 120 | S | R |
| 137 | N | S, P |
| 138 | A | V, H, D, P |
| 139 | N | P, A, H |
| 141 | T | E, G, A, R |
| 146 | S | R |
| 157 | G | Q, N, L, R, A |
| 159 | R | Y |
| 176 | N | K |
| 180 | N | T, E |
| 183 | K | R |
| 184 | Q | S |
| 185 | D | N, L |
| 186 | E | V, A |
| 189 | S | T |
| 233 | G | A |
| 255 | Y | D |
| 245 | T | E |
| 276 | M | V |
| 282 | H | N, P |
| 288 | A | E, R, V |
| 291 | V | I |
| 295 | T | I |
| 297 | V | L |
| 311 | G | S |
| 315 | E | G, S |

Figure 11B

| Position (mature numbering) | Wild type residue | Particular Variants |
|---|---|---|
| 341 | L | Y, V |
| 354 | F | Y |
| 363 | K | A, L |
| 369 | N | P |
| 370 | T | P |
| 380 | A | R, T, P |
| 383 | E | S |
| 385 | R | S, V, T |
| 402 | E | R, T, D, P, N |

PHYTASES AND USES THEREOF

BACKGROUND OF THE INVENTION

Phytate is the major but indigestible form of phosphorus found in plant-based feeds. It is considered as an anti-nutritional factor (ANF) that needs to be reduced or removed from cereal-based foods and feeds. Under acidic conditions, phytate interacts with positively charged dietary proteins leading to the formation of phytate-protein aggregates and precipitates, which results in a decreased accessibility for proteases, and consequently in inefficient protein digestion. Phytate also acts as a strong chelating agent that binds different vital metal ions in foods and feeds in the small intestine of monogastric organisms, leading to nutritional deficiencies of many important minerals like calcium, zinc, etc. in animals.

Phytase is a phosphatase that catalyzes the hydrolysis of O—P bonds in phytate and releases inorganic usable phosphorous. Phytase plays versatile roles in agricultural and feeding fields. Ruminant animals such as cattle and sheep can utilize the phytate in grains as a source of phosphorus since they have bacteria in the gut that produces phytases. Non-ruminants like pigs, poultry, fish, dogs, birds, etc. require extrinsic phytase to liberate inorganic phosphorous. Hence, addition of inorganic phosphorous, a non-renewable and expensive mineral, to feeds for monogastric animals is a common practice, which incurs heavy costs to the feed industry. Consequently, phytase produced from various sources have emerged as one of the most effective and lucrative supplement to these species' diets to enhance the nutritional value of animal feeds and decrease animals' phosphorus excretion that leads to environmental pollution.

Phytase in feeds can be inactivated by temperature during feed processing (pelleting), by the low pH or pepsin in the upper part of the gastrointestinal tract of an animal. Selle and Ravindran laid out the characteristics for an ideal feed enzyme, namely; 1) a high specific activity per unit of protein, 2) good thermostability during feed processing, 3) high activity in the typical pH range of the animal gut, 4) resistance to gastric proteases, and 5) good stability under ambient temperatures. (SELLE, P. H. and RAVINDRAN, V. (2007) Microbial phytase in poultry nutrition. Animal Feed Science and Technology 135: 1-41.)

The heat treatment of feeds can involve heat alone or a combination of both heat and pressure. The most common form of thermal treatment in the manufacture of poultry feeds is pelleting. The pelleting process first involves the mash feed passing through a conditioner. In the conditioner the cold feed is exposed to dry steam which is added under pressure. This process helps to improve pellet durability and also increases mill throughputs and reduces energy consumption. Under these conditions, plant cells are crushed, which is favorable for the digestion process in animals. Nissinen found that moderate conditioning less than 85° C. was optimal for broiler performance and high conditioning temperature at 95° C. resulted in poorer body weight gain and feed conversion ratio (NISSINEN, V. (1994) The effects and interactions of enzymes and hydrothermal pre-treatments and their contribution to feeding value. International Milling Flour and Feed, May: 21-22.). Pelleting process at 65-85° C. usually result in improving the availability of nutrients due to the rupture of the cell wall matrix (PICKFORD, J. R. (1992) Effects of processing on the stability of heat labile nutrients in animal feeds, in: GARNSWORTHY, P. C., HARESIGN, W. & COLE, D. J. A. (Eds) Recent Advances in Animal Nutrition, pp. 177-192 (Butterworth-Heinemann, Oxford, U.K.) and deactivation of enzyme inhibitors present in cereals (SAUNDERS, R. M. (1975) α-Amylase inhibitors in wheat and other cereals. Cereal Foods World 20: 282-285.). The effect of the damage on the phytase activity due to high pressure appears to be small; it is mainly the high temperature which results from the high energy input that inactivates the enzyme. Thus, developing a thermostable Phytase provides an attractive solution for cost-effective processes in the feed industry.

New applications of phytase in human foods are similarly important as those in animal feeds because indigestible phytate chelates essential minerals and contributes to deficiencies of these nutrients in approximately two to three billion people. The applications of phytase in human health and medicine represent other new exciting areas. In addition, phytase has great potentials for industrial applications including food processing and biofuel production. Thermostable phytase, along with xylanase, have been suggested as effective additives in the pulp and paper industry.

BRIEF SUMMARY OF THE INVENTION

Accordingly, the present invention provides variant phytases and methods of using them. In one aspect, the invention provides compositions comprising a variant phytase enzyme comprising at least one amino acid substitutions as compared to SEQ ID NO:1, wherein said amino acid substitution is at a position number selected from the group consisting of 1, 30, 36, 39, 55, 60, 65, 69, 73, 74, 79, 85, 101, 109, 111, 116, 118, 120, 137, 138, 139, 141, 146, 157, 159, 176, 180, 183, 184, 185, 186, 189, 233, 245, 255, 276, 282, 288, 291, 295, 297, 311, 315, 341, 354, 363, 369, 370, 380, 383, 385 and 402.

In another aspect, the invention provides compositions comprising a variant phytase enzyme comprising at least one amino acid substitutions as compared to SEQ ID NO:1, wherein said amino acid substitution is at a position number selected from the group consisting of 1, 30, 36, 39, 55, 60, 65, 69, 73, 74, 79, 85, 101, 109, 111, 116, 118, 120, 137, 138, 139, 141, 146, 157, 159, 176, 180, 183, 184, 185, 186, 189, 233, 245, 255, 276, 282, 288, 291, 295, 297, 311, 315, 341, 354, 363, 369, 370, 380, 383, 385 and 402, and wherein said variant phytase enzyme is at least 95% identical to SEQ ID NO:1. In additional aspects, the variant phytase enzyme is at least 96%, 97%, 98% or 99% identical to SEQ ID NO:1, although not SEQ ID NO:1.

In a further aspect, the invention provides compositions comprising a variant phytase enzyme comprising at least one amino acid substitutions as compared to SEQ ID NO:1, wherein said amino acid substitution is at a position number selected from the group consisting of 1, 30, 36, 39, 55, 60, 65, 69, 73, 74, 79, 85, 101, 109, 111, 116, 118, 120, 137, 138, 139, 141, 146, 157, 159, 176, 180, 183, 184, 185, 186, 189, 233, 245, 255, 276, 282, 288, 291, 295, 297, 311, 315, 341, 354, 363, 369, 370, 380, 383, 385 and 402, wherein said variant phytase enzyme has at least at least 1.1 fold better activity as compared to SEQ ID NO:1 under a condition selected from the group consisting of thermostability at 58° C., thermostability at 66° C., pH stability at pH 4.5 and pH stability at pH 5.5.

In an additional aspect, the invention provides variant phytase enzymes with one or more amino acid substitutions selected from the group consisting of Q1S, Q1V, Q1N, Q30K, A36K, T39D, I55V, H60S, H60Q, R65H, D69N, A73D, A73E, K74D, K74P, K74L, Q79L, Q79R, Q79A, Q79G, Q79F, I85V, A101L, A109D, A109E, A109G, A109F, A109P, T111S, T111D, T111Q, A116Y, A116P, A116R, A116S, T118R, T118S, S120R, N137S, N137P, A138V, A138H, A138D, A138P, N139P, N139A, N139H, T141E, T141G, T141A, T141R, S146R, G157Q, G157N, G157L, G157R, G157A, R159Y, N176K, N180T, N180E, K183R, Q184S, D185N, D185L, E186V, E186A, S189T, G233A, Y255D, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V, R385T, E402R, E402T, E402D, E402P and E402N.

In a further aspect, the invention provides variant phytase enzymes with amino acid substitutions at one of said positions, two of said positions, three of said positions, four of said positions, five of said positions, six of said positions, seven of said positions, eight of said positions, nine of said positions, ten of said positions, eleven of said positions, twelve of said positions, thirteen of said positions, fourteen of said positions, fifteen of said positions, sixteen of said positions, seventeen of said positions, eighteen of said positions, nineteen of said positions or twenty of said positions.

In an additional aspect, the invention provides variant phytase enzymes comprising the amino acid substitutions I55V/G157Q/R159Y/Y255D/F354Y/A380P and at least one further amino acid substitution selected from the group consisting of Q1S, Q1V, Q1N, Q30K, A36K, T39D, H60S, H60Q, R65H, D69N, A73D, A73E, K74D, K74P, K74L, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, N139P, N139A, N139H, T141E, T141G, T141A, T141R, S146R, N176K, N180T, N180E, K183R, Q184S, D185N, D185L, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, E383S, R385S, R385V, R385T, E402R, E402T, E402D, E402P and E402N.

In a further aspect, the invention provides variant phytase enzymes comprising the amino acid substitutions H60Q/D69N/K74D/S120R/N137P and at least one further amino acid substitution selected from the group consisting of Q1S, Q1V, Q1N, Q30K, A36K, T39D, I55V, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, A138V, A138H, A138D, A138P, N139P, N139A, N139H, T141E, T141G, T141A, T141R, S146R, G157Q, G157N, G157L, G157R, G157A, R159Y, N176K, N180T, N180E, K183R, Q184S, D185N, D185L, E186V, E186A, S189T, G233A, Y255D, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V, R385T, E402R, E402T, E402D, E402P and E402N.

In an additional aspect, the invention provides variant phytases comprising the amino acid substitutions I55V/G157Q/R159Y/Y255D/F354Y/A380P/H60Q/D69N/K74D/S120R/N137P and at least one further amino acid substitution selected from the group consisting of Q1S, Q1V, Q1N, Q30K, A36K, T39D, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, T141E, T141G, T141A, T141R, S146R, N176K, N180T, N180E, K183R, Q184S, D185N, D185L, E186V, E186A, S189T, G233A, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V and R385T.

In a further aspect, the invention provides variant phytases comprising the amino acid substitutions N139A/N176K/D185N/E402D and at least one further amino acid substitution selected from the group consisting of Q1S, Q1V, Q1N, Q30K, A36K, T39D, I55V, H60S, H60Q, R65H, D69N, A73D, A73E, K74D, K74P, K74L, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, T141E, T141G, T141A, T141R, S146R, G157Q, G157N, G157L, G157R, G157A, R159Y, N180T, N180E, K183R, Q184S, E186V, E186A, S189T, G233A, Y255D, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V and R385T.

In an additional aspect, the invention provides variant phytases comprising the amino acid substitutions I55V/G157Q/R159Y/Y255D/F354Y/A380P/H60Q/D69N/K74D/S120R/N137P/N139A/N176K/D185N/E402D and at least one further amino acid substitution selected from the group consisting of Q1S, Q1V, Q1N, Q30K, A36K, T39D, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, A138V, A138H, A138D, A138P, T141E, T141G, T141A, T141R, S146R, N180T, N180E, K183R, Q184S, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, E383S, R385S, R385V and R385T.

In a further aspect, the invention provides variant phytase enzymes having an amino acid substitution set selected from the group consisting of those depicted in FIGS. 5, 6, 7 and 8.

In an additional aspect, the invention provides compositions of variant phytases further comprising animal feed.

In a further aspect, the invention provides nucleic acids encoding the variant phytase enzymes of the invention.

In an additional aspect, the invention provides expression vectors comprising the nucleic acids encoding the variant phytase enzymes of the invention.

In a further aspect, the invention provides host cells comprising the expression vectors or the nucleic acids of the invention.

In an additional aspect, the invention provides methods of making a variant phytase enzyme comprising culturing the host cells of the invention under conditions wherein the variant phytase enzyme is produced, and recovering the enzyme.

In some aspects, the invention relates to phytase variants having improved thermal properties, such as thermostability, heat-stability, steam stability, temperature profile, and/or pelleting stability, with thermostable variant enzymes of particular use in many embodiments.

In additional aspects, the invention relates to phytase variants having improved pelleting stability and/or improved acid-stability.

The method of the invention thus relates to phytase variants having an improved pH profile.

The method of the invention thus relates to phytase variants having improved protease stability, in particular pepsin stability, found in non-ruminant stomachs.

The method of the invention thus relates to phytase variants having improved performance in animal feed (such as an improved release and/or degradation of phytate).

The invention further relates to polynucleotide comprising nucleotide sequences which encode the phytase variants produced by the method, nucleic acid constructs comprising the polynucleotides operably linked to one or more control sequences that direct the production of the polypeptide in an expression host, recombinant expression vectors comprising such nucleic acid constructs, and recombinant host cells comprising a nucleic acid construct and/or an expression vector.

In an additional aspect, the invention relates to methods for producing phytase variants as provided comprising (a) cultivating a host cell to produce a supernatant comprising the phytase; and (b) recovering the phytase.

In a further aspect, the invention relates to methods for improving the nutritional value of an animal feed, by adding a phytase variant of the invention to the feed, processes for reducing phytate levels in animal manure by feeding an animal with an effective amount of the feed, methods for the treatment of vegetable proteins, comprising the step of adding a phytase variant to at least one vegetable protein, and the use of a phytase variant of a composition of the invention.

The invention also provides a method for producing a fermentation product such as, e.g., ethanol, beer, wine, comprising fermenting a carbohydrate material in the presence of a phytase variant, a method for producing ethanol comprising fermenting a carbohydrate material in the presence of a phytase variant and producing ethanol.

BRIEF DESCRIPTION OF THE DRAWINGS

FIG. 1 depicts the nucleic acid and amino acid sequences of the mature EcPhytase G1P, as well as the amino acid and nucleic acid sequence of the endogenous signal sequence. In the parental *E. coli* strain, the G1P phytase is produced using an endogenous signal sequence, which is clipped off during expression to form the mature G1P enzyme, as is depicted in FIG. 9. It should be noted that as for the variant phytases, the phytase can be produced in some organisms using a signal sequence, either the depicted signal sequence or a signal sequence exogenous to the phytase (e.g. a signal peptide from a different protein or organism, or a synthetic (non-naturally occurring) sequence. That is, depending on the production host organism, the endogeneous (native to the phytase) signal can be used, or, for example, a signal sequence that is native to the production host can be recombinantly and operably combined with the mature sequence. In some production organism embodiments, the phytase is produced without the use of a signal sequence. Thus, for production in *E. coli*, for example, the DNA encoding the signal sequence is linked to the DNA encoding the mature protein.

FIG. 2 depicts the nucleic acid and amino acid sequences of EcPhytase G2P. The G2P sequence has the following variants as compared to G1P: I55V/G157Q/R159Y/Y255D/F354Y/A380P. The protein and DNA sequences are for the mature enzyme.

FIG. 3 depicts the nucleic acid and amino acid sequences of EcPhytase G3P. In addition to the I55V/G157Q/R159Y/Y255D/F354Y/A380P of G2P the G3P variant also has H60Q/D69N/K74D/S120R/N137P such that the G3P has the variants I55V/H60Q/D69N/K74D/S120R/N137P/G157Q/R159Y/Y255D/F354Y/A380P relative to G1P.

FIG. 4 depicts the nucleic acid and amino acid sequences of EcPhytase G4P. In addition to the I55V/H60Q/D69N/K74D/S120R/N137P/G157Q/R159Y/Y255D/F354Y/A380P of G3P (inclusive of G2P and the G3P additional variants), the G4P variant has N139A/N176K/D185N/E402D as well (forming the G4P total set of I55V/H60Q/D69N/K74D/S120R/N137P/N139A/G157Q/R159Y/N176K/D185N/Y255D/F354Y/A380P/E402D).

FIGS. 5A, 5B, 5C and 5D depict a table showing some of the first generation of variant phytases, and their pH and thermostability. CL0000004 is the G1P parent, whose amino acid sequence is SEQ ID NO:1 as shown in FIG. 1. The majority of the variants are single amino acid variants, as seen in the "AA Mutations" column, which shows the amino acid substitution (e.g. from T to E for CL00000605 at position 141) as compared to G1P. The values of the table were determined as shown in Examples 5 and 6.

FIG. 6 depicts a table showing additional first generation of variant phytases, and their pH and thermostability. CL0000004 is the G1P parent, whose amino acid sequence is SEQ ID NO:1 as shown in FIG. 1. The CL00000430 is the G2P sequence as depicted in FIG. 2. The values of the table were determined as shown in Examples 5 and 6.

FIGS. 7A, 7B and 7C depict a table showing second generation of variant phytases, and their pH and thermostability. CL00000430 is the G2P parent, whose amino acid sequence is SEQ ID NO:5 as shown in FIG. 2. It should be noted that the amino acid mutations listed in the table are relative to the G2P, rather than the G1P. That is, in addition to the amino acid mutations of the Figure, all of the variant phytases listed in FIGS. 7A, 7B and 7C also contain the variants I55V/G157Q/R159Y/Y255D/F354Y/A380P, which are the variants of G2P. Thus the G3P variant (CL00005023) has I55V/G157Q/R159Y/Y255D/F354Y/A380P in addition to H60Q/D69N/K74D/S120R/N137P such that the G3P has the variants I55V/H60Q/D69N/K74D/S120R/N137P/G157Q/R159Y/Y255D/F354Y/A380P relative to G1P. The values of the table were determined as shown in Examples 5 and 6.

FIG. 8 depicts a table showing a third generation of variant phytases, and their pH and thermostability. CL00005023 is the G3P, and the additional mutations listed in the table are relative to the G3P variant, rather than the G1P or G2P. That is, in addition to the amino acid mutations of the Figure, all of the variant phytases listed in FIG. 8 also contain the variants I55V/H60Q/D69N/K74D/S120R/N137P/G157Q/R159Y/Y255D/F354Y/A380P relative to G1P. Thus the G4P total set of variants is I55V/H60Q/D69N/K74D/S120R/N137P/N139A/G157Q/R159Y/N176K/D185N/Y255D/F354Y/A380P/E402D. The values of the table were determined as shown in Examples 5 and 6.

FIGS. 9A and 9B depict the alignment of the G1P (wild type, SEQ ID NO: 1), G2P (SEQ ID NO: 5), G3P (SEQ ID NO: 7) and G4P (SEQ ID NO: 9) variant phytases. The signal sequence, containing the first 22 amino acids, is double underlined. The catalytic domain is bolded and underlined, with the catalytic residues in large italic font and the substrate binding residues in large bolded font. Note that the number of FIG. 9 is inclusive of the signal peptide, which is not the numbering of the variant positions outlined herein; that is, the variant positions herein count the glutamine (Q) residue as position 1 of the mature protein. Thus, the catalytic domain is amino acids 29-374 in the figure but amino acids 7 to 352 in the mature protein. Similarly, the H39 and D326 catalytic residues of the figure are H17 and D304 in mature numbering, and the substrate binding residues are R16, R92 and R267.

FIGS. 11A and 11B depict a variant table showing some preferred variants in some embodiments of the invention. As described herein, these may be combined in any combination, and with variant sets as outlined herein.

DETAILED DESCRIPTION OF THE INVENTION

I. Introduction

Figure 10A:
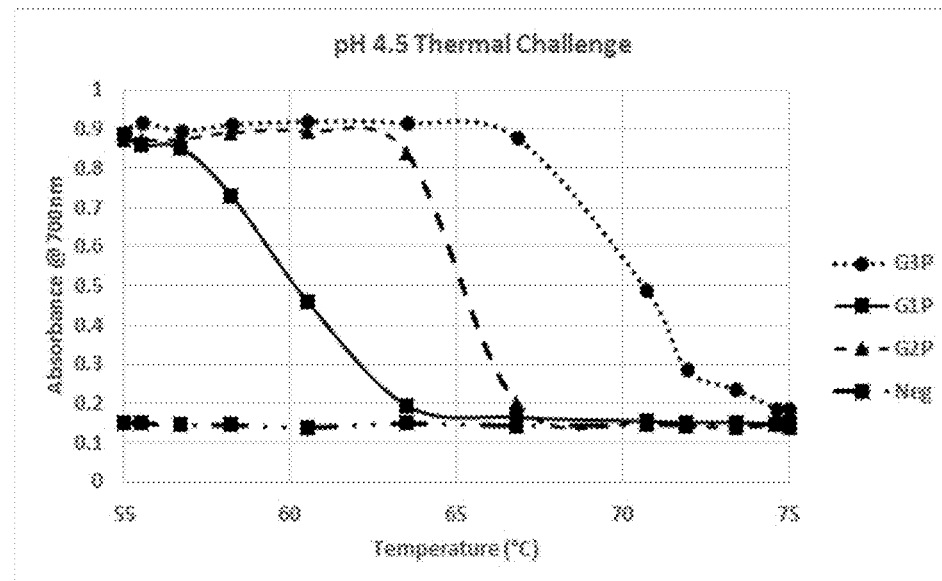
FIGS. 10A and 10B show the thermal challenge of selected sequences (including G1P, G2P and G3P). The thermal challenge was a 5 minute challenge at the indicated temperature as discussed in Example 7.

Phytases decompose phytate (inositol hexakisphosphate (IP6) or phytic acid when in the salt form), which is the primary storage of phosphate in plants. Monogastric animals such as swine, poultry and fish (as well as humans) cannot digest phytate, leading to phosphorus excretion in the manure, which poses an environmental concern in agricultural areas. In addition, the phytate can lead to aggregation of proteins, reducing protein availability, as well as chelate minerals and trace elements, further reducing the available nutrients for the animals.

The addition of phytase to animal feed was introduced several decades ago and can reduce phosphorus excretion by up to 50% while also allowing the animal better access to the available nutrients. However, under the conditions which are used in the processing of many foods, including both animal feeds made from plant sources as well as foods for humans (cereals, etc.) such as higher temperatures and different pHs, many wild type phytases are not very stable, leading to inefficient conversion of the phytate and/or the cost prohibitive addition of more enzyme. Similarly, other uses for phytase such as in the production of biofuels also can include higher temperatures and/or different pHs. Accordingly, it is an object of the present invention to provide variant phytases with improved properties, including thermostability and other biochemical properties as outlined herein, that lead to improved outcomes such as less environmental stress due to lowered phosphorus excretion, better feed conversion to animal weight and better access to nutrients.

II. Definitions

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g. the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution I55V refers to a variant polypeptide, in this case a phytase, in which the isoleucine at position 55 is replaced with valine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233#, E233( ) or E233del designates a deletion of glutamic acid at position 233. Additionally, EDA233- or EDA233# designates a deletion of the sequence GluAspAla that begins at position 233.

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. In the present case, some embodiments utilize G1P, G2P or G3P as parent polypeptides, with the former being preferred.

By "variant protein" or "protein variant", or "variant" as used herein is meant a protein that differs from that of a parent protein by virtue of at least one amino acid modification. Protein variant may refer to the protein itself, a composition comprising the protein, or the amino sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide is a wild type sequence, for example the wild type *E. coli* phytase designated "G1P" herein. As further discussed below, the protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it. Thus, by "variant phytase" herein is meant a novel phytase that has at least one amino acid modification in the amino acid sequence as compared to a parent phytase enzyme. As discussed herein, in some cases the parent phytase is a second or higher generation of variant; that is, as shown in FIG. 6, the G2P phytase has 6 amino acid substitutions as compared to the wild type G1P parent. However, as shown in FIG. 7, the G3P has 5 amino acid substitutions as compared to the G2P parent, but a total of 11 amino acid substitutions as compared to the G1P. Unless otherwise noted or as will be obvious from the context, the variant phytases of the invention generally are compared to the wild type G1P sequence. Additionally, unless otherwise noted, the variant phytases of the invention are enzymatically active, that is, there is detectable phytase activity using the phytase assay described in Example 5, using an assay without temperature treatment.

As used herein, "protein" herein is meant at least two covalently attached amino acids, which includes proteins, polypeptides, oligopeptides and peptides. The peptidyl group generally comprise naturally occurring amino acids and peptide bonds. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Histidine 82 (also referred to as His82 or H82) is a residue at position 82 in the G1P parental enzyme.

By "non-naturally occurring modification" as used herein is meant an amino acid modification that is not found in the parent (e.g. G1P) enzyme.

By "amino acid" and "amino acid identity" as used herein is meant one of the 20 naturally occurring amino acids that are coded for by DNA and RNA.

By "position" as used herein is meant a location in the sequence of a protein. In general, the position number (which is more fully discussed below) is relative to the first amino acid of the mature phytase sequence, e.g. excluding the signal peptide.

By "phytase" herein is meant a protein with phytase activity. By "phytase activity" herein is meant that the enzyme catalyzes the hydrolysis of phytate (myo-inositol hexakisphosphate) to (1) myo-inositol and/or (2) mono-, di-, tri-, tetra- and/or penta-phosphates thereof and (3) inorganic phosphate. Enzymes having detectable activity in the assay outlined below and in Examples 5 are considered phytases herein.

By "identity" in reference to two sequences herein is meant that the same amino acid is at the same position considering the alignment. The degree of identity between an amino acid sequence of the present invention ("invention sequence") and the parent amino acid sequence referred to in the claims (e.g. for G1P, SEQ ID NO:1) is calculated as the number of exact matches in an alignment of the two sequences, divided by the length of the "invention sequence," or the length of the SEQ ID NO:1, whichever is the shortest. The result is expressed in percent identity as calculated below.

For purposes of the present invention, the mature polypeptide disclosed in SEQ ID NO:1 is used to determine the corresponding amino acid residue in another phytase of the present invention. The amino acid sequence of another phytase is aligned with the mature polypeptide disclosed in SEQ ID NO:1, and based on the alignment, the amino acid position number corresponding to any amino acid residue in the mature polypeptide disclosed in SEQ ID NO:1 is determined using the Needleman-Wunsch algorithm (Needleman and Wunsch, 1970, J. Mol. Biol. 48: 443-453) as implemented in the Needle program of the EMBOSS package (EMBOSS: The European Molecular Biology Open Software Suite, Rice et al., 2000, Trends Genet. 16: 276-277), preferably version 5.0.0 or later. The parameters used are gap open penalty of 10, gap extension penalty of 0.5, and the EBLOSUM62 (EMBOSS version of BLOSUM62) substitution matrix.

Identification of the corresponding amino acid residue in another phytase can be determined by an alignment of multiple polypeptide sequences using several computer programs including, but not limited to, MUSCLE (multiple sequence comparison by log-expectation; version 3.5 or later; Edgar, 2004, Nucleic Acids Research 32: 1792-1797), MAFFT (version 6.857 or later; Katoh and Kuma, 2002, Nucleic Acids Research 30: 3059-3066; Katoh et al., 2005, Nucleic Acids Research 33: 511-518; Katoh and Toh, 2007, Bioinformatics 23: 372-374; Katoh et al., 2009, Methods in Molecular Biology 537: 39-64; Katoh and Toh, 2010, Bioinformatics 26: 1899-1900), EMBOSS EMMA employing ClustalW (1.83 or later; Thompson et al., 1994, Nucleic Acids Research 22: 4673-4680), and EMBL-EBI employing Clustal Omega (Sievers and Higgins, 2014, Methods Mol Biol. 2014; 1079:105-16), using their respective default parameters.

When the other enzyme has diverged from the polypeptide of SEQ ID NO:1 such that traditional sequence-based comparison fails to detect their relationship (Lindahl and Elofsson, 2000, J. Mol. Biol. 295: 613-615), other pairwise sequence comparison algorithms can be used. Greater sensitivity in sequence-based searching can be attained using search programs that utilize probabilistic representations of polypeptide families (profiles) to search databases. For example, the PSI-BLAST program generates profiles through an iterative database search process and is capable of detecting remote homologs (Atschul et al., 1997, Nucleic Acids Res. 25: 3389-3402). Even greater sensitivity can be achieved if the family or superfamily for the polypeptide has one or more representatives in the protein structure databases. Programs such as GenTHREADER (Jones, 1999, J. Mol. Biol. 287: 797-815; McGuffin and Jones, 2003, Bioinformatics 19: 874-881) utilize information from a variety of sources (PSI-BLAST, secondary structure prediction, structural alignment profiles, and solvation potentials) as input to a neural network that predicts the structural fold for a query sequence. Similarly, the method of Gough et al., 2000, J. Mol. Biol. 313: 903-919, can be used to align a sequence of unknown structure with the superfamily models present in the SCOP database. These alignments can in turn be used to generate homology models for the polypeptide, and such models can be assessed for accuracy using a variety of tools developed for that purpose.

For proteins of known structure, several tools and resources are available for retrieving and generating structural alignments. For example the SCOP superfamilies of proteins have been structurally aligned, and those alignments are accessible and downloadable. Two or more protein structures can be aligned using a variety of algorithms such as the distance alignment matrix (Holm and Sander, 1998, Proteins 33: 88-96) or combinatorial extension (Shindyalov and Bourne, 1998, Protein Engineering 11: 739-747), and implementation of these algorithms can additionally be utilized to query structure databases with a structure of interest in order to discover possible structural homologs (e.g., Holm and Park, 2000, Bioinformatics 16: 566-567).

In describing the variants of the present invention, the nomenclature described below is adapted for ease of reference. The standardly accepted IUPAC single letter or three letter amino acid abbreviation is employed.

For an amino acid substitution, the following nomenclature is used herein: Original amino acid, position, substituted amino acid. Accordingly, the substitution of glutamine at position 441 with proline is designated as "Gln441Pro" or "Q441P". Multiple mutations are separated by forward slash marks ("/"), e.g., "I91L/A133G/Y169W", representing substitutions at positions 91, 133 and 169, respectively.

| Abbreviation | 1 letter abbreviation | Amino acid name |
|---|---|---|
| Ala | A | Alanine |
| Arg | R | Arginine |
| Asn | N | Asparagine |
| Asp | D | Aspartic acid |
| Cys | C | Cysteine |
| Gln | Q | Glutamine |
| Glu | E | Glutamic acid |
| Gly | G | Glycine |
| His | H | Histidine |
| Ile | I | Isoleucine |
| Leu | L | Leucine |
| Lys | K | Lysine |
| Met | M | Methionine |
| Phe | F | Phenylalanine |
| Pro | P | Proline |
| Ser | S | Serine |
| Thr | T | Threonine |
| Trp | W | Tryptophan |
| Tyr | Y | Tyrosine |
| Val | V | Valine |

By "isolated" in the context of a phytase herein is meant that the polypeptide is devoid of other proteins. In a particular embodiment the phytase of the invention is isolated. The term "isolated" as used herein refers to a polypeptide which is at least 20% pure, preferably at least 40% pure, more preferably at least 60% pure, even more preferably at least 80% pure, most preferably at least 90% pure, and even most preferably at least 95 to 98% pure, as determined by SDS-PAGE. In particular, it is preferred that the polypeptides are in "essentially pure form", i.e., that the polypeptide preparation is essentially free of other polypeptide material with which it is natively associated. This can be accomplished, for example, by preparing the polypeptide by means of well-known recombinant methods or by classical purification methods.

By "recombinant enzyme" herein is meant that the enzyme is produced by recombinant techniques and that nucleic acid encoding the variant enzyme of the invention is operably linked to at least one exogeneous (e.g. not native to the parent phytase) sequence, including, for examples, promoters, terminators, signal sequences, etc., as are more fully outlined below.

The term "nucleic acid construct" refers to a nucleic acid molecule, either single-stranded or double-stranded, which is isolated from a naturally occurring gene or is modified to contain segments of nucleic acids in a manner that would not otherwise exist in nature or which is synthetic, and which comprises one or more control sequences.

The term "operably linked" refers to a configuration in which a control sequence is placed at an appropriate position relative to the coding sequence of a polynucleotide such that the control sequence directs expression of the coding sequence.

III. Phytases of the Invention

Accordingly, the present invention provides variant phytases with improved activity that can be used in a variety of applications, including animal and human nutritional and feed products and the production of biofuels such as bioethanol.

In general, the variant phytases of the invention have modified, improved biochemical properties as compared to the wild type parental phytase, "EcPhytase G1P" or "G1P" (e.g. "generation 1 parent"), SEQ ID NO:1 herein, as shown in FIG. 1. The biochemical properties of the variant phytases that can be improved herein include, but are not limited to, pH activity, pH stability, thermostability, specific activity, formulation stability (including liquid, solid and pellets), performance in animals and/or animal feed and protease stability.

The variant phytases of the invention have one or more improved properties as compared to G1P. By "improved" herein is meant a desirable change of at least one biochemical property. "Improved function" can be measured as a percentage increase or decrease of a particular activity, or as a "fold" change, with increases of desirable properties (e.g. pH stability, thermostability) or decreases of undesirable properties (e.g. protease sensitivity). That is, a variant phytase may have a 10% increase in thermostability or a 10% decrease in protease sensitivity, as compared to G1P. Alternatively, a variant phytase may have a 2-fold increase in pH stability or a 3-fold decrease in protease sensitivity. In general, percentage changes are used to describe changes in biochemical activity of less than 100%, and fold-changes are used to describe changes in biochemical activity of greater than 100% (as compared to the parental enzyme, in many cases G1P). In the present invention, percentage changes (usually increases) of biochemical activity of at least about 10%, 20%, 30%, 40%, 50%, 60%, 70%, 80%, 90%, 95%, 98% and 99% can be accomplished. In the present invention, a "fold increase" (or decrease) is measured as compared to the starting or parent enzyme. For example, as shown in the Figures, G2P has a 11.64 fold increase in temperature tolerance as compared to G1P: this is calculated by [(activity of variant)/(activity of parent)]. In many embodiments, the improvement is at least one and a half fold (1.5 fold), 2 fold, 3 fold, 4 fold, 5 fold, 6 fold, 7 fold, 8 fold, 9 fold, or 10 fold or higher.

In general, improvements are measured as compared to the G1P enzyme using a phytase activity assay, under conditions that challenge the variant phytase against the G1P enzyme.

A. Phytase Assay

The basic phytase assay is run as shown in Example 5 and as follows: after challenge under the appropriate conditions of temperature, pH, etc., the sample is added to a 0.1 M solution of sodium acetate containing 2 mM of sodium phytate substrate ($C_6H_6Na_{12}O_{24}P_6$, FW: 923.81) at pH 4.5 and pH 5.5. The reaction is incubated at 24° C., 150 rpm for 30 minutes. The reaction is quenched with half the solution volume of 5% w/v trichloroacetic acid. A sample volume of fresh of coloring reagent is added, which is made by mixing four volumes of 2.5% ammonium molybdate solution in 5.5% sulfuric acid and one volume of 2.7% ferrous sulfate solution. The sample is shaken for 30 seconds and then centrifuged at 4000 rpm for 2 minutes. A volume of supernatant is diluted with an equivalent volume of water and absorbance read at 700 nm. In some cases, it is useful to use "Phytase Units", or PU, defined as the amount of phytase required to liberate 1 µmol of inorganic phosphate per minute. The enzyme may be a purified sample, a fermentation sample, or a raw sample.

The variant phytases of the invention can have an improvement one or more of a number of biochemical properties, including, but not limited to, pH activity, pH stability, thermostability, specific activity, formulation stability (including liquid, solid and pellets), performance in animals and/or animal feed and/or protease stability.

B. Thermostability

In many embodiments, the variant phytases of the invention have increased thermostability, particularly under the conditions used to produce animal feeds, for example, which frequently use high temperatures during the pelleting process for periods of time that traditionally inactivate wild type phytases. "Thermostability" in this context means that the variant enzymes are more stable than the parent phytase (e.g. G1P) under the same thermal challenge conditions, that is, the activity of the variant is higher than that of the G1P under identical conditions (generally using the phytase assay as outlined herein and as shown in Example 6).

In one embodiment, the variant phytases are more stable than the parent phytase when exposed to temperatures of 40° C., 45° C., 50° C., 55° C., 58° C., 60° C., 65° C., 66° C., 70° C., 75° C., 80° C. and/or 85° C. for a period of time, generally ranging from about 1, 2, 3, 4, 5, 6, 7, 8, 9 or 10 minutes or longer, depending on the ultimate conditions for the use of the variant phytase, with some embodiments utilizing thermal challenge times of 5 minutes to 10 minutes, 5 minutes to 15 minutes, 5 minutes to 60 minutes, 10 minutes to 60 minutes all finding use in the present invention. In some embodiments, a challenge of 85° C. and 5 minutes is used.

Accordingly, in some embodiments the variant phytases have increased thermostability as compared to a parent phytase, particularly G1P, for at least 5 minutes at 50° C., at least 5-10 minutes at 55° C., at least 5-10 minutes at 58° C., at least 5-10 minutes at 60° C., at least 5-10 minutes at 66° C. and in some embodiments at least 5-10 minutes at 70° C.

In addition, pH can be a consideration for thermostability as well. Accordingly, in some embodiments the variant phytases have increased thermostability as compared to a parent phytase for at least 5 minutes at 58° C. at pH 5.5, at least 5 minutes at 58° C. at pH 4.5, for at least 5 minutes at 66° C. at 4.5 or at least 5 minutes at 66° C. at pH 5.5.

Accordingly, as shown in FIGS. 5, 6, 7 and 8, a number of variant phytases of the invention exhibit increased thermostability.

C. pH Stability

In many embodiments, the variant phytases of the invention have increased pH stability at lower pHs, to address the lower pH of the stomach and gastrointestinal tract of non-ruminant animals. That is, many phytases have pH profiles that are suboptimal for the lowered pH environment where the activity is desired in the animal "Increased pH stability" in this context means that the variant enzymes are more stable than the parent phytase (e.g. G1P) under the same pH challenge conditions, that is, the activity of the variant is higher than that of the G1P under identical conditions (generally using the phytase assay as outlined herein and as shown in Example 6).

Accordingly, in some embodiments the variant phytases have increased pH stability as compared to a parent phytase, particularly G1P, for at least 5 minutes at around pH 4.5 and at least 5 minutes at around pH 5.5.

D. Specific Activity Assays

In some embodiments, the variant phytases of the invention have increased specific activity as compared to a parent phytase, particularly G1P. By "specific activity" herein is meant the activity per amount of enzyme, generally determined by dividing the enzymatic activity of a sample (sometimes measure in "phytase units" as discussed herein) by the amount of phytase enzyme, generally determined as is known in the art.

E. Protease Susceptibility

In some embodiments, the variant phytases of the invention are less susceptible to protease degradation than the parent enzyme under identical conditions. In some cases, protease degradation during the production of variant phytases in a production host organism by protease enzymes produced by the host organism can be a problem, thus resulting in lower yield of active enzyme. This is generally determined as is known in the art, for example by allowing proteolytic degradation and then doing N-terminal sequencing on the resulting fragments to determine the cleavage site(s). In some cases, depending on the variant and the host production organism, there may not be significant proteolytic degradation.

As needed, as will be appreciated by those in the art, the specific mutations that can be made will depend on the endogenous proteases that the host organism produces, and also generally occurs in surface exposed loop structures or turns that are therefore accessible to proteases. For example, production of phytases in *A. niger* fungal production organisms can lead to proteolytic degradation; see Wyss et al., Appl. And Environ. Microbiol. February 1999:359-366, hereby incorporated by reference in its entirety.

IV. Phytases

Accordingly, the present invention provides variant phytases with one or more improved properties as compared to the wild type G1P sequence, wherein the phytase is not G1P (SEQ ID NO:1).

In some embodiments, the variant phytases of the invention have at least 87% identity to G1P, with enzymes having at least 90%, 91%, 92%, 93%, 94%, 95%, 96%, 97%, 98% and 99% identity (but less than 100% identity) also finding use in the present invention. Accordingly, some embodiments provide variant phytases with from 90% to 99% identity to G1P (SEQ ID NO:1), with other embodiments providing 95% to 99% identity, with the proviso that the phytase is not G1P (SEQ ID NO:1).

In some embodiments, the variant phytases of the invention have at least 87% identity to G2P, with enzymes having at least 90%, 91%, 92%, 93%, 94%, 95%, 96%, 97%, 98% and 99% identity also finding use in the present invention, with the proviso that the phytase is not G1P (SEQ ID NO:1).

In some embodiments, the variant phytases of the invention have the amino acid substitutions I55V/G157Q/R159Y/Y255D/F354Y/A380P and are at least 95%, 96%, 97%, 98% or 99% identical to SEQ ID NO:5.

In some embodiments, the variant phytases of the invention have at least 87% identity to G3P, with enzymes having at least 90%, 91%, 92%, 93%, 94%, 95%, 96%, 97%, 98% and 99% identity also finding use in the present invention, with the proviso that the phytase is not G1P (SEQ ID NO:1).

In some embodiments, the variant phytases of the invention have the amino acid substitutions I55V/H60Q/D69N/K74D/S120R/N137P/G157Q/R159Y/Y255D/F354Y/A380P and are at least 95%, 96%, 97%, 98% or 99% identical to SEQ ID NO:7.

In some embodiments, the variant phytases of the invention have the amino acid substitutions H60Q/D69N/K74D/S120R/N137P and are at least 95%, 96%, 97%, 98% or 99% identical to SEQ ID NO:5, SEQ ID NO:1 and/or SEQ ID NO:7.

In some embodiments, the variant phytases of the invention have at least 87% identity to G4P, with enzymes having at least 90%, 91%, 92%, 93%, 94%, 95%, 96%, 97%, 98% and 99% identity also finding use in the present invention, with the proviso that the phytase is not G1P (SEQ ID NO:1).

In some embodiments, the variant phytases of the invention have the amino acid substitutions N139A/N176K/D185N/E402D and are at least 95%, 96%, 97%, 98% or 99% identical to SEQ ID NO:7, SEQ ID NO:1 and/or SEQ ID NO:9.

In some embodiments, the variant phytases of the invention have the amino acid substitutions I55V/H60Q/D69N/K74D/S120R/N137P/N139A/G157Q/R159Y/N176K/D185N/Y255D/F354Y/A380P/E402D and are at least 95%, 96%, 97%, 98% or 99% identical to SEQ ID NO:9.

V. Specific Variant Phytases

Accordingly, the present invention provides a number of specific variant phytases with improved activity, specifically thermal stability and/or pH stability, and in particular thermal stability at particular pHs and temperature as outlined herein.

In some embodiments, the variant phytase has one or more amino acid substitutions at a position (relative to G1P) selected from the group consisting of 1, 30, 36, 39, 55, 60, 65, 69, 73, 74, 79, 85, 101, 109, 111, 116, 118, 120, 137, 138, 139, 141, 146, 157, 159, 176, 180, 183, 184, 185, 186, 189, 233, 245, 255, 276, 282, 288, 291, 295, 297, 311, 315, 341, 354, 363, 369, 370, 380, 383, 385 and 402.

In some embodiments, the variant phytase has one or more amino acid substitutions selected from the group consisting of Q1S, Q1V, Q1N, Q30K, A36K, T39D, I55V, H60S, H60Q, R65H, D69N, A73D, A73E, K74D, K74P, K74L, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, N139P, N139A, N139H, T141E, T141G, T141A, T141R, S146R, G157Q, G157N, G157L, G157R, G157A, R159Y, N176K, N180T, N180E, K183R, Q184S, D185N, D185L, E186V, E186A, S189T, G233A, Y255D, T245E, Y255D, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V, R385T, E402R, E402T, E402D, E402P and E402N.

In some embodiments, the variant phytase has an amino acid substitution of the glutamine at position 1 of SEQ ID NO:1. In some embodiments, the substitution is with any other of the 19 naturally occurring amino acids, namely serine, threonine, asparagine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from Q1S, Q1V and Q1N.

In some embodiments, the variant phytase has an amino acid substitution of the glutamine at position 30 of SEQ ID NO:1. In some embodiments, the substitution is with any other of the 19 naturally occurring amino acids, namely serine, threonine, asparagine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is Q30K.

In some embodiments, the variant phytase has an amino acid substitution of the alanine at position 36 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is A36K.

In some embodiments, the variant phytase has an amino acid substitution of the threonine at position 39 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan, valine and tyrosine, with some embodiments not utilizing cysteine (due to possible disulfide formation) or proline (due to steric effects). In some embodiments, the amino acid substitution is T39D.

In some embodiments, the variant phytase has an amino acid substitution of the isoleucine at position 55 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, threonine, leucine, methionine, phenylalanine, tryptophan, valine and tyrosine, with some embodiments not utilizing cysteine (due to possible disulfide formation) or proline (due to steric effects). In some embodiments, the amino acid substitution is I55V.

In some embodiments, the variant phytase has an amino acid substitution of the histidine at position 60 of SEQ ID NO:1. In some embodiments, the substitution is with any other of the 19 naturally occurring amino acids, namely serine, threonine, asparagine, glutamine, lysine, arginine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from H60Q and H60S.

In some embodiments, the variant phytase has an amino acid substitution of the aspartic acid at position 65 of SEQ ID NO:1. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is R65H.

In some embodiments, the variant phytase has an amino acid substitution of the aspartic acid at position 69 of SEQ ID NO:1. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is D69N.

In some embodiments, the variant phytase has an amino acid substitution of the alanine at position 73 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A73D and A73E.

In some embodiments, the variant phytase has an amino acid substitution of the lysine at position 74 of SEQ ID NO:1. In some embodiments, the substitution is with any other of the 19 naturally occurring amino acids, namely serine, threonine, asparagine, glutamine, alanine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from K74D, K74L and K74P.

In some embodiments, the variant phytase has an amino acid substitution of the glutamine at position 79 of SEQ ID NO:1. In some embodiments, the substitution is with any other of the 19 naturally occurring amino acids, namely serine, threonine, asparagine, glutamine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from Q79L, Q79A, Q79G, Q79R and Q79F.

In some embodiments, the variant phytase has an amino acid substitution of the alanine at position 85 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is I85V.

In some embodiments, the variant phytase has an amino acid substitution of the alanine at position 101 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is A101L.

In some embodiments, the variant phytase has an amino acid substitution of the alanine at position 109 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A109D, A109E, A109F, A109P, A109G.

In some embodiments, the variant phytase has an amino acid substitution of the threonine at position 111 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from T111S, T111D and T111Q.

In some embodiments, the variant phytase has an amino acid substitution of the alanine at position 116 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A116Y, A116P, A116R and A116S.

In some embodiments, the variant phytase has an amino acid substitution of the threonine at position 118 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from T118S and T118R.

In some embodiments, the variant phytase has an amino acid substitution of the serine at position 120 of SEQ ID NO:1. In some embodiments, the substitution is with any other of the 19 naturally occurring amino acids, namely threonine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from S120R.

In some embodiments, the variant phytase has an amino acid substitution of the asparagine at position 137 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from N137P and N137S.

In some embodiments, the variant phytase has an amino acid substitution of the alanine at position 138 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A138V, A138H, A138P and A138D.

In some embodiments, the variant phytase has an amino acid substitution of the asparagine at position 139 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from N139P, N139A and N139H.

In some embodiments, the variant phytase has an amino acid substitution of the threonine at position 141 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from E (T141E), G (T141G), A (T141A), R (T141R).

In some embodiments, the variant phytase has an amino acid substitution of the serine at position 146 of SEQ ID NO:1. In some embodiments, the substitution is with any other of the 19 naturally occurring amino acids, namely threonine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from R (S146R).

In some embodiments, the variant phytase has an amino acid substitution of the glycine at position 157 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from G157Q, G157N, G157L, G157R, G157A.

In some embodiments, the variant phytase has an amino acid substitution of the arginine at position 159 of SEQ ID NO:1. In some embodiments, the substitution is with any other of the 19 naturally occurring amino acids, namely serine, threonine, glutamine, lysine, asparagine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is R159Y.

In some embodiments, the variant phytase has an amino acid substitution of the asparagine at position 176 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is N176K.

In some embodiments, the variant phytase has an amino acid substitution of the asparagine at position 180 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from N180T and N180E.

In some embodiments, the variant phytase has an amino acid substitution of the lysine at position 183 of SEQ ID NO:1. In some embodiments, the substitution is with any other of the 19 naturally occurring amino acids, namely serine, threonine, asparagine, glutamine, alanine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is K183R.

In some embodiments, the variant phytase has an amino acid substitution of the glutamine at position 184 of SEQ ID NO:1. In some embodiments, the substitution is with any other of the 19 naturally occurring amino acids, namely serine, threonine, asparagine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is Q184S.

In some embodiments, the variant phytase has an amino acid substitution of the aspartic acid at position 185 of SEQ ID NO:1. In some embodiments, the substitution is with any other of the 19 naturally occurring amino acids, namely serine, threonine, asparagine, glutamine, lysine, arginine, histidine, glutamic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from D185L and D185N.

In some embodiments, the variant phytase has an amino acid substitution of the glutamic acid at position 186 of SEQ ID NO:1. In some embodiments, the substitution is with any other of the 19 naturally occurring amino acids, namely serine, threonine, asparagine, glutamine, lysine, arginine, histidine, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from E186V and E186A.

In some embodiments, the variant phytase has an amino acid substitution of the threonine at position 189 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is S189T.

In some embodiments, the variant phytase has an amino acid substitution of the threonine at position 233 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is G233A.

In some embodiments, the variant phytase has an amino acid substitution of the threonine at position 245 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is T245E.

In some embodiments, the variant phytase has an amino acid substitution of the tyrosine at position 255 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, alanine, isoleucine, leucine, phenylalanine, tryptophan valine and methionine, with some embodiments not utilizing cysteine (due to possible disulfide formation) or proline (due to steric effects). In some embodiments, the amino acid substitution is Y255D.

In some embodiments, the variant phytase has an amino acid substitution of the methionine at position 276 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, alanine, isoleucine, leucine, phenylalanine, tryptophan valine and tyrosine, with some embodiments not utilizing cysteine (due to possible disulfide formation) or proline (due to steric effects). In some embodiments, the amino acid substitution is M276V.

In some embodiments, the variant phytase has an amino acid substitution of the methionine at position 282 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, alanine, isoleucine, leucine, phenylalanine, tryptophan valine and tyrosine, with some embodiments not utilizing cysteine (due to possible disulfide formation) or proline (due to steric effects). In some embodiments, the amino acid substitution is selected from H282N and H282P.

In some embodiments, the variant phytase has an amino acid substitution of the alanine at position 288 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A288E, A288R and A288V.

In some embodiments, the variant phytase has an amino acid substitution of the alanine at position 291 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is V291I.

In some embodiments, the variant phytase has an amino acid substitution of the alanine at position 295 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is T295I.

In some embodiments, the variant phytase has an amino acid substitution of the alanine at position 297 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from V297L.

In some embodiments, the variant phytase has an amino acid substitution of the alanine at position 311 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is G311S.

In some embodiments, the variant phytase has an amino acid substitution of the glutamic acid at position 315 of SEQ ID NO:1. In some embodiments, the substitution is with any other of the 19 naturally occurring amino acids, namely serine, threonine, asparagine, glutamine, lysine, arginine, histidine, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from E315G and E315S.

In some embodiments, the variant phytase has an amino acid substitution of the leucine at position 341 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, alanine, isoleucine, methionine, phenylalanine, tryptophan valine and tyrosine, with some embodiments not utilizing cysteine (due to possible disulfide formation) or proline (due to steric effects). In some embodiments, the amino acid substitution is selected from L341Y and L341V.

In some embodiments, the variant phytase has an amino acid substitution of the phenylalanine at position 354 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, asparagine, tryptophan valine and tyrosine, with some embodiments not utilizing cysteine (due to possible disulfide formation) or proline (due to steric effects). In some embodiments, the amino acid substitution is F354Y.

In some embodiments, the variant phytase has an amino acid substitution of the lysine at position 363 of SEQ ID NO:1. In some embodiments, the substitution is with any other of the 19 naturally occurring amino acids, namely serine, threonine, asparagine, glutamine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from K363A and K363L.

In some embodiments, the variant phytase has an amino acid substitution of the asparagine at position 369 of SEQ ID NO:1. In some embodiments, the substitution is with any other of the 19 naturally occurring amino acids, namely serine, threonine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is N369P.

In some embodiments, the variant phytase has an amino acid substitution of the threonine at position 370 of SEQ ID NO:1. In some embodiments, the substitution is with any other of the 19 naturally occurring amino acids, namely serine, asparagine, glutamine, lysine, arginine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is T370P.

In some embodiments, the variant phytase has an amino acid substitution of the alanine at position 380 of SEQ ID NO:1. In some embodiments, the substitution is with any other of the 19 naturally occurring amino acids, namely serine, threonine, asparagine, glutamine, lysine, arginine, histidine, glutamic acid, aspartic acid, cysteine, glycine, proline, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from A380R, A380T and A380P.

In some embodiments, the variant phytase has an amino acid substitution of the glutamic acid at position 383 of SEQ ID NO:1. In some embodiments, the substitution is with any other of the 19 naturally occurring amino acids, namely serine, threonine, glutamine, lysine, arginine, histidine, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is E383S.

In some embodiments, the variant phytase has an amino acid substitution of the arginine at position 385 of SEQ ID NO:1. In some embodiments, the substitution is with any other of the 19 naturally occurring amino acids, namely serine, threonine, asparagine, glutamine, lysine, histidine, glutamic acid, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from R385V, R385T and R385S.

In some embodiments, the variant phytase has an amino acid substitution of the glutamic acid at position 402 of SEQ ID NO:1. In some embodiments, the substitution is with any other of the 19 naturally occurring amino acids, namely serine, threonine, asparagine, glutamine, lysine, arginine, histidine, aspartic acid, cysteine, glycine, proline, alanine, isoleucine, leucine, methionine, phenylalanine, tryptophan valine and tyrosine, with some embodiments not utilizing cysteine (due to possible disulfide formation) or proline (due to steric effects). In some embodiments, the amino acid substitution is selected from E402D, E402P, E402N, E402R and E402T.

In some embodiments the variant phytase comprises the G2P variants I55V/G157Q/R159Y/Y255D/F354Y/A380P and a further amino acid substitution selected from the group consisting of Q1S, Q1V, Q1N, Q30K, A36K, T39D, H60S, H60Q, R65H, D69N, A73D, A73E, K74D, K74P, K74L, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, N139P, N139A, N139H, T141E, T141G, T141A, T141R, S146R, N176K, N180T, N180E, K183R, Q184S, D185N, D185L, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, E383S, R385S, R385V, R385T, E402R, E402T, E402D, E402P and E402N.

In some embodiments, the variant phytase comprises the G3P variants H60Q/D69N/K74D/S120R/N137P, and at least one of the additional single amino acid variants outlined above, including, but not limited to, Q1S, Q1V, Q1N, Q30K, A36K, T39D, I55V, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, A138V, A138H, A138D, A138P, N139P, N139A, N139H, T141E, T141G, T141A, T141R, S146R, G157Q, G157N, G157L, G157R, G157A, R159Y, N176K, N180T, N180E, K183R, Q184S, D185N, D185L, E186V, E186A, S189T, G233A, Y255D, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V, R385T, E402R, E402T, E402D, E402P and E402N.

In some embodiments, the variant phytase comprises the G2P and G3P variants I55V/G157Q/R159Y/Y255D/F354Y/A380P/H60Q/D69N/K74D/S120R/N137P, and at least one of the additional single amino acid variants outlined above, including, but not limited to, Q1S, Q1V, Q1N, Q30K, A36K, T39D, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, A138V, A138H, A138D, A138P, N139P, N139A, N139H, T141E, T141G, T141A, T141R, S146R, N176K, N180T, N180E, K183R, Q184S, D185N, D185L, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, E383S, R385S, R385V, R385T, E402R, E402T, E402D, E402P and E402N.

In some embodiments, the variant phytase comprises the G4P variants N139A/N176K/D185N/E402D, and at least one of the additional single amino acid variants outlined above, including, but not limited to, Q1S, Q1V, Q1N, Q30K, A36K, T39D, I55V, H60S, H60Q, R65H, D69N, A73D, A73E, K74D, K74P, K74L, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, S120R, N137S, N137P, A138V, A138H, A138D, A138P, T141E, T141G, T141A, T141R, S146R, G157Q, G157N, G157L, G157R, G157A, R159Y, N180T, N180E, K183R, Q184S, E186V, E186A, S189T, G233A, Y255D, T245E, M276V, H282N, H282P, A288E, A288R, A288V, V291I, T295I, V297L, G311S, E315G, E315S, L341Y, L341V, F354Y, K363A, K363L, N369P, T370P, A380R, A380T, A380P, E383S, R385S, R385V and R385T.

In some embodiments, the variant phytase comprises the G4P variants I55V/G157Q/R159Y/Y255D/F354Y/A380P/ H60Q/D69N/K74D/S120R/N137P/N139A/N176K/D185N/ E402D and a further amino acid substitution selected from the group consisting of Q1S, Q1V, Q1N, Q30K, A36K, T39D, R65H, A73D, A73E, Q79L, Q79R, Q79A, Q79G, Q79F, I85V, A101L, A109D, A109D, A109E, A109G, A109F, A109P, T111S, T111D, T111Q, A116Y, A116P, A116R, A116S, T118R, T118S, A138V, A138H, A138D, A138P, T141E, T141G, T141A, T141R, S146R, N180T, N180E, K183R, Q184S, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, E383S, R385S, R385V and R385T.

Some particular embodiments of the present invention are phytase variants as compared to SEQ ID NO:1 having an amino acid substitution set selected from the group consisting of N139H/K183R, R159Y/Y255D/V291I/V297L/ G311S, I55V/Y255D/G311S/F354Y, G233A/Y255D/ V291I, I85V/G157Q/V291I/V297L/G311S/F354Y, A101L/ Y255D, I55V/I85V/Y255D/V291I, I55V/F354Y, I55V/ I85V/Y255D/V291I/F354Y, R159Y/Y255D/V291I, A101L/ R159Y/S189T/T295I/F354Y, Q30K/I85V/Y255D/A380P, G157Q/R159Y, I55V/I85V/S189T/G233A/Y255D/F354Y/ A380P, I55V/I85V/S189T/V297L/G311S, F354Y, I55V/ I85V/A101L/G157Q/G233A/F354Y, I55V/G157Q/Y255D/ V291I/V297L/F354Y, R159Y, I55V, Y255D, I55V/G157Q/ R159Y/Y255D/F354Y/A380P, I55V/R159Y/Y255D/ V297L/A380P, I55V/I85V/G157Q/G233A/Y255D/V297L/ F354Y, I55V/A101L/G157Q/Y255D/V297L, I55V/A101L/ G157Q/Y255D/F354Y, I55V/N291I/V297L, and I55V/ I85V/A101L/R159Y/S189T/Y255D/F354Y. Of these, I55V/ G157Q/R159Y/Y255D/F354Y/A380P is particularly useful in some embodiments.

In some embodiments, the variant phytases of the invention comprise amino acid substitution sets selected from the group consisting of T39D/K74D/Q157A, T39D/H60Q/ K74D/N137P/T141A, K74D, T39D/D69N/N137P/T141E/ Q157A, S120R/N137P/A138V, T39D/H60Q, K74D/ T141A, K74P, N137P/A138V, H60Q/D69N, T39D/D69N/ K74D, H60Q/D69N/K74D/S120R/N137P, D69N/N137P/ A138V/T141E, T39D/D69N/K74P/T111D/S120R/T141A, N137P/T141A, N137P/A138V/T141E, T39D/K74D, T39D/ H60S/T111D/S120R, T39D/H60S/D69N/S120R/N137S/ T141A, H60Q/N137P/A138V/T141A, Q157L, S120R/ N137P, H60Q, S120R, S120R/N137S/A138V/Q157L, H60S/K74Y/S120R/A138V, T39D/D69N/S120R/T141A, H60S, T39D/S120R, T39D, H60S/K74D, T39D/T111D, T39D/H60S, T39D/K74D/T141E, K74D/T111D/T141E/ Q157N, H60S/K74D/T111D/S120R/T141E/Q157N, T39D/ K74D/S120R/T141E, T141E, K74D/S120R/Q157N, K74D/ S120R, T111D/S120R/T141E, H60S/R65H, H60S/D69N/ T111D/N137P, T39D/N137S/T141A, H60Q/D69N/N137P/ A138V, T39D/D69N/K74D/N137P/A138V/T141E, K74D/ T111D/T141A, N137S/A138V/T141E, H60Q/K74P/ N137S/T141E, D69N/K74P, H60Q/K74P, T39D/T111D/ S120R, T39D/H60Q/K74D/T111D/S120R, T39D/D69N, D69N/K74D, and T39D/H60Q/D69N/N137S/A138V.

In some embodiments, the G2P amino acid variant set, I55V/G157Q/R159Y/Y255D/F354Y/A380P, is added to a second set (the "G3P set", above) to provide variant phytase enzymes with an amino acid substitution sets selected from the group consisting of I55V/G157Q/R159Y/Y255D/ F354Y/A380P/T39D/K74D/Q157A, I55V/G157Q/R159Y/ Y255D/F354Y/A380P/T39D/H60Q/K74D/N137P/T141A, I55V/G157Q/R159Y/Y255D/F354Y/A380P/K74D, I55V/ G157Q/R159Y/Y255D/F354Y/A380P/T39D/D69N/ N137P/T141E/Q157A, I55V/G157Q/R159Y/Y255D/ F354Y/A380P/S120R/N137P/A138V, I55V/G157Q/ R159Y/Y255D/F354Y/A380P/T39D/H60Q, I55V/G157Q/ R159Y/Y255D/F354Y/A380P/K74D/T141A, I55V/ G157Q/R159Y/Y255D/F354Y/A380P/K74P, I55V/G157Q/ R159Y/Y255D/F354Y/A380P/N137P/A138V, I55V/ G157Q/R159Y/Y255D/F354Y/A380P/H60Q/D69N, I55V/ G157Q/R159Y/Y255D/F354Y/A380P/T39D/D69N/K74D, I55V/G157Q/R159Y/Y255D/F354Y/A380P/H60Q/D69N/ K74D/S120R/N137P, I55V/G157Q/R159Y/Y255D/F354Y/ A380P/D69N/N137P/A138V/T141E, I55V/G157Q/R159Y/ Y255D/F354Y/A380P/T39D/D69N/K74P/T111D/S120R/ T141A, I55V/G157Q/R159Y/Y255D/F354Y/A380P/ N137P/T141A, I55V/G157Q/R159Y/Y255D/F354Y/ A380P/N137P/A138V/T141E, I55V/G157Q/R159Y/ Y255D/F354Y/A380P/T39D/K74D, I55V/G157Q/R159Y/ Y255D/F354Y/A380P/T39D/H60S/T111D/S120R, I55V/ G157Q/R159Y/Y255D/F354Y/A380P/T39D/H60S/D69N/ S120R/N137S/T141A, I55V/G157Q/R159Y/Y255D/ F354Y/A380P/H60Q/N137P/A138V/T141A, I55V/G157Q/ R159Y/Y255D/F354Y/A380P/Q157L, I55V/G157Q/ R159Y/Y255D/F354Y/A380P/S120R/N137P, I55V/ G157Q/R159Y/Y255D/F354Y/A380P/H60Q, I55V/ G157Q/R159Y/Y255D/F354Y/A380P/S120R, I55V/ G157Q/R159Y/Y255D/F354Y/A380P/S120R/N137S/ A138V/Q157L, I55V/G157Q/R159Y/Y255D/F354Y/ A380P/H60S/K74Y/S120R/A138V, I55V/G157Q/R159Y/ Y255D/F354Y/A380P/T39D/D69N/S120R/T141A, I55V/ G157Q/R159Y/Y255D/F354Y/A380P/H60S, I55V/ G157Q/R159Y/Y255D/F354Y/A380P/H60Q, I55V/ G157Q/R159Y/Y255D/F354Y/A380P/T39D/S120R, I55V/ G157Q/R159Y/Y255D/F354Y/A380P/T39D, I55V/ G157Q/R159Y/Y255D/F354Y/A380P/H60S/K74D, I55V/ G157Q/R159Y/Y255D/F354Y/A380P/T39D/T111D, I55V/ G157Q/R159Y/Y255D/F354Y/A380P/T39D/H60S, I55V/ G157Q/R159Y/Y255D/F354Y/A380P/T39D/K74D/ T141E, I55V/G157Q/R159Y/Y255D/F354Y/A380P/K74D/ T111D/T141E/Q157N, I55V/G157Q/R159Y/Y255D/ F354Y/A380P/H60S/K74D/T111D/S120R/T141E/Q157N, I55V/G157Q/R159Y/Y255D/F354Y/A380P/T39D/K74D/
S120R/T141E, I55V/G157Q/R159Y/Y255D/F354Y/
A380P/T141E, I55V/G157Q/R159Y/Y255D/F354Y/
A380P/K74D/S120R/Q157N, I55V/G157Q/R159Y/
Y255D/F354Y/A380P/K74D/S120R, I55V/G157Q/R159Y/
Y255D/F354Y/A380P/T111D/S120R/T141E, I55V/
G157Q/R159Y/Y255D/F354Y/A380P/H60S/R65H, I55V/
G157Q/R159Y/Y255D/F354Y/A380P/H60S/D69N/
T111D/N137P, I55V/G157Q/R159Y/Y255D/F354Y/
A380P/T39D/N137S/T141A, I55V/G157Q/R159Y/Y255D/
F354Y/A380P/H60Q/D69N/N137P/A138V, I55V/G157Q/
R159Y/Y255D/F354Y/A380P/T39D/D69N/K74D/N137P/
A138V/T141E, I55V/G157Q/R159Y/Y255D/F354Y/
A380P/K74D/T111D/T141A, I55V/G157Q/R159Y/
Y255D/F354Y/A380P/N137S/A138V/T141E, I55V/
G157Q/R159Y/Y255D/F354Y/A380P/H60Q/K74P/
N137S/T141E, I55V/G157Q/R159Y/Y255D/F354Y/
A380P/D69N/K74P/, I55V/G157Q/R159Y/Y255D/F354Y/
A380P/H60Q/K74P, I55V/G157Q/R159Y/Y255D/F354Y/
A380P/T39D/T111D/S120R, I55V/G157Q/R159Y/Y255D/
F354Y/A380P/T39D/H60Q/K74D/T111D/S120R, I55V/
G157Q/R159Y/Y255D/F354Y/A380P/T39D/D69N, I55V/
G157Q/R159Y/Y255D/F354Y/A380P/D69N/K74D, and
I55V/G157Q/R159Y/Y255D/F354Y/A380P/T39D/H60Q/
D69N/N137S/A138V.

Suitable variant phytases of the invention are those listed in SEQ ID NOs: 12 to 171, and those depicted in the Figures.

VI. Nucleic Acids of the Invention

The present invention additional provides nucleic acids encoding the variant phytases of the invention. As will be appreciated by those in the art, due to the degeneracy of the genetic code, an extremely large number of nucleic acids may be made, all of which encode the variant phytases of the present invention. Thus, having identified a particular amino acid sequence, those skilled in the art could make any number of different nucleic acids, by simply modifying the sequence of one or more codons in a way which does not change the amino acid sequence of the protein. Thus, providing the amino acid sequence allows the generation of a very large number of different nucleic acid sequences encoding the proteins.

In some embodiments, specific variant phytases are encoded by specific nucleic acid sequences, as are listed in SEQ ID NOs 172-332.

As is known in the art, the nucleic acids encoding the components of the invention can be incorporated into expression vectors as is known in the art, and depending on the host cells used to produce the heterodimeric antibodies of the invention. Generally the nucleic acids are operably linked to any number of regulatory elements (promoters, origin of replication, selectable markers, ribosomal binding sites, inducers, etc.). The expression vectors can be extrachromosomal or integrating vectors.

The nucleic acids and/or expression vectors of the invention are then transformed into any number of different types of host cells as is well known in the art, including mammalian, bacterial, yeast, insect and/or fungal cells, with bacteria and fungi finding use in many embodiments.

A. Preparation of Variants

The nucleic acids encoding the variant phytases of the invention can be prepared using any mutagenesis procedure known in the art, such as site-directed mutagenesis and synthetic gene construction as are well known in the art.

Synthetic gene construction entails in vitro synthesis of a designed polynucleotide molecule to encode a polypeptide of interest. Gene synthesis can be performed utilizing a number of techniques, such as the multiplex microchip-based technology described by Tian et al. (2004, *Nature* 432: 1050-1054) and similar technologies wherein oligonucleotides are synthesized and assembled upon photo-programmable microfluidic chips. A preferred technique is GenScript®.

i. Regulatory Sequences

The present invention also relates to nucleic acid constructs comprising a polynucleotide encoding a variant of the present invention operably linked to one or more control sequences that direct the expression of the coding sequence in a suitable host cell under conditions compatible with the control sequences.

The polynucleotide may be manipulated in a variety of ways to provide for expression of a variant. Manipulation of the polynucleotide prior to its insertion into a vector may be desirable or necessary depending on the expression vector. The techniques for modifying polynucleotides utilizing recombinant DNA methods are well known in the art.

The control sequence may be a promoter, a polynucleotide which is recognized by a host cell for expression of the polynucleotide. The promoter contains transcriptional control sequences that mediate the expression of the variant. The promoter may be any polynucleotide that shows transcriptional activity in the host cell including mutant, truncated, and hybrid promoters, and may be obtained from genes encoding extracellular or intracellular polypeptides either homologous or heterologous to the host cell.

Examples of suitable promoters for directing transcription of the nucleic acid constructs of the present invention in a filamentous fungal host cell are promoters obtained from the genes for *Aspergillus nidulans* acetamidase, *Aspergillus niger* neutral alpha-amylase, *Aspergillus niger* acid stable alpha-amylase, *Aspergillus niger* or *Aspergillus awamori* phytase (glaA), *Aspergillus oryzae* TAKA amylase, *Aspergillus oryzae* alkaline protease, *Aspergillus oryzae* triose phosphate isomerase, *Fusarium oxysporum* trypsin-like protease (WO 96/00787), *Fusarium venenatum* amyloglucosidase (WO 00/56900), *Fusarium venenatum* Dania (WO 00/56900), *Fusarium venenatum* Quinn (WO 00/56900), *Rhizomucor miehei* lipase, *Rhizomucor miehei* aspartic proteinase, *Trichoderma reesei* beta-glucosidase, *Trichoderma reesei* cellobiohydrolase I, *Trichoderma reesei* cellobiohydrolase II, *Trichoderma reesei* endoglucanase I, *Trichoderma reesei* endoglucanase II, *Trichoderma reesei* endoglucanase III, *Trichoderma reesei* endoglucanase IV, *Trichoderma reesei* endoglucanase V, *Trichoderma reesei* xylanase I, *Trichoderma reesei* xylanase II, *Trichoderma reesei* beta-xylosidase, as well as the NA2-tpi promoter (a modified promoter from an *Aspergillus* neutral alpha-amylase gene in which the untranslated leader has been replaced by an untranslated leader from an *Aspergillus* triose phosphate isomerase gene; non-limiting examples include modified promoters from an *Aspergillus niger* neutral alpha-amylase gene in which the untranslated leader has been replaced by an untranslated leader from an *Aspergillus nidulans* or *Aspergillus oryzae* triose phosphate isomerase gene); and mutant, truncated, and hybrid promoters thereof.

In a yeast host, useful promoters are obtained from the genes for *Saccharomyces cerevisiae* enolase (ENO-1), *Saccharomyces cerevisiae* galactokinase (GAL1), *Saccharomyces cerevisiae* alcohol dehydrogenase/glyceraldehyde-3-phosphate dehydrogenase (ADH1, ADH2/GAP), *Saccharomyces cerevisiae* triose phosphate isomerase (TPI), *Saccharomyces cerevisiae* metallothionein (CUP1), and *Saccharomyces cerevisiae* 3-phosphoglycerate kinase. Other useful promoters for yeast host cells are described by Romanos et al., 1992, *Yeast* 8: 423-488.

The control sequence may also be a transcription terminator, which is recognized by a host cell to terminate transcription. The terminator sequence is operably linked to the 3'-terminus of the polynucleotide encoding the variant. Any terminator that is functional in the host cell can be used.

In some embodiments, terminators for filamentous fungal host cells are obtained from the genes for *Aspergillus nidulans* anthranilate synthase, *Aspergillus niger* phytase, *Aspergillus niger* alpha-glucosidase, *Aspergillus oryzae* TAKA amylase, and *Fusarium oxysporum* trypsin-like protease.

In some embodiments, terminators for yeast host cells are obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are described by Romanos et al., 1992, supra.

The control sequence can also be an mRNA stabilizer region downstream of a promoter and upstream of the coding sequence of a gene which increases expression of the gene.

Examples of suitable mRNA stabilizer regions are obtained from a *Bacillus thuringiensis* cryIIIA gene (WO 94/25612) and a *Bacillus subtilis* SP82 gene (Hue et al., 1995, *Journal of Bacteriology* 177: 3465-3471).

The control sequence can also be a leader, a nontranslated region of an mRNA that is important for translation by the host cell. The leader sequence is operably linked to the 5'-terminus of the polynucleotide encoding the variant. Any leader that is functional in the host cell may be used.

In some embodiments, leaders for filamentous fungal host cells are obtained from the genes for *Aspergillus oryzae* TAKA amylase and *Aspergillus nidulans* triose phosphate isomerase.

In some embodiments, suitable leaders for yeast host cells are obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

The control sequence can also be a polyadenylation sequence, a sequence operably linked to the 3'-terminus of the variant-encoding sequence and, when transcribed, is recognized by the host cell as a signal to add polyadenosine residues to transcribed mRNA. Any polyadenylation sequence that is functional in the host cell may be used.

In some embodiments, polyadenylation sequences for filamentous fungal host cells are obtained from the genes for *Aspergillus nidulans* anthranilate synthase, *Aspergillus niger* phytase, *Aspergillus niger* alpha-glucosidase, *Aspergillus oryzae* TAKA amylase, and *Fusarium oxysporum* trypsin-like protease.

Useful polyadenylation sequences for yeast host cells are described by Guo and Sherman, 1995, *Mol. Cellular Biol.* 15: 5983-5990.

The control sequence may also be a signal peptide coding region that encodes a signal peptide linked to the N-terminus of a variant and directs the variant glucoamhylase being expressed into the cell's secretory pathway. The 5'-end of the coding sequence of the polynucleotide may inherently contain a signal peptide coding sequence naturally linked in translation reading frame with the segment of the coding sequence that encodes the variant glucoamhylase. Alternatively, the 5'-end of the coding sequence may contain a signal peptide coding sequence that is foreign to the coding sequence. A foreign signal peptide coding sequence may be required where the coding sequence does not naturally contain a signal peptide coding sequence. Alternatively, a foreign signal peptide coding sequence may simply replace the natural signal peptide coding sequence in order to enhance secretion of the variant glucoamhylase. However, any signal peptide coding sequence that directs the expressed variant into the secretory pathway of a host cell may be used.

Effective signal peptide coding sequences for filamentous fungal host cells are the signal peptide coding sequences obtained from the genes for *Aspergillus niger* neutral amylase, *Aspergillus niger* phytase, *Aspergillus oryzae* TAKA amylase, *Humicola insolens* cellulase, *Humicola insolens* endoglucanase V, *Humicola lanuginosa* lipase, and *Rhizomucor miehei* aspartic proteinase.

Useful signal peptides for yeast host cells are obtained from the genes for *Saccharomyces cerevisiae* alpha-factor and *Saccharomyces cerevisiae* invertase. A particular signal sequence is shown in FIG. 1, SEQ ID NO:2.

Where both signal peptide and propeptide sequences are present, the propeptide sequence is positioned next to the N-terminus of the variant and the signal peptide sequence is positioned next to the N-terminus of the propeptide sequence.

It may also be desirable to add regulatory sequences that regulate expression of the variant relative to the growth of the host cell. Examples of regulatory systems are those that cause expression of the gene to be turned on or off in response to a chemical or physical stimulus, including the presence of a regulatory compound. Regulatory systems in prokaryotic systems include the lac, tac, and trp operator systems. In yeast, the ADH2 system or GAL1 system may be used. In filamentous fungi, the *Aspergillus niger* phytase promoter, *Aspergillus oryzae* TAKA alpha-amylase promoter, and *Aspergillus oryzae* phytase promoter can be used. Other examples of regulatory sequences are those that allow for gene amplification. In eukaryotic systems, these regulatory sequences include the dihydrofolate reductase gene that is amplified in the presence of methotrexate, and the metallothionein genes that are amplified with heavy metals. In these cases, the polynucleotide encoding the variant would be operably linked with the regulatory sequence.

1. Expression Vectors

The present invention also relates to recombinant expression vectors comprising a polynucleotide encoding a variant of the present invention, a promoter, and transcriptional and translational stop signals. The various nucleotide and control sequences may be joined together to produce a recombinant expression vector that may include one or more convenient restriction sites to allow for insertion or substitution of the polynucleotide encoding the variant at such sites. Alternatively, the polynucleotide may be expressed by inserting the polynucleotide or a nucleic acid construct comprising the polynucleotide into an appropriate vector for expression. In creating the expression vector, the coding sequence is located in the vector so that the coding sequence is operably linked with the appropriate control sequences for expression.

The recombinant expression vector may be any vector (e.g., a plasmid or virus) that can be conveniently subjected to recombinant DNA procedures and can bring about expression of the polynucleotide. The choice of the vector will typically depend on the compatibility of the vector with the host cell into which the vector is to be introduced. The vector can be a linear or closed circular plasmid.

The vector may be an autonomously replicating vector, i.e., a vector that exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one that, when introduced into the host cell, is integrated into the genome and replicated together with the chromosome(s) into which it has been integrated. Furthermore, a single vector or plasmid or two or more vectors or plasmids that together contain the total DNA to be introduced into the genome of the host cell, or a transposon, may be used. Vectors contemplated for use with the methods of the invention include both integrating and non-integrating vectors.

In some embodiments, the vector contains one or more selectable markers that permit easy selection of transformed, transfected, transduced, or the like cells. A selectable marker is a gene the product of which provides for biocide or viral resistance, resistance to heavy metals, prototrophy to auxotrophs, and the like.

Suitable markers for yeast host cells include, but are not limited to, ADE2, HIS3, LEU2, LYS2, MET3, TRP1, and URA3. Selectable markers for use in a filamentous fungal host cell include, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Preferred for use in an *Aspergillus* cell are *Aspergillus nidulans* or *Aspergillus oryzae* amdS and pyrG genes and a *Streptomyces hygroscopicus* bar gene.

In some embodiments, the vector contains an element(s) that permits integration of the vector into the host cell's genome or autonomous replication of the vector in the cell independent of the genome.

For integration into the host cell genome, the vector can rely on the polynucleotide's sequence encoding the variant or any other element of the vector for integration into the genome by homologous or non-homologous recombination. Alternatively, the vector can contain additional polynucleotides for directing integration by homologous recombination into the genome of the host cell at a precise location(s) in the chromosome(s). To increase the likelihood of integration at a precise location, the integrational elements should contain a sufficient number of nucleic acids, such as 100 to 10,000 base pairs, 400 to 10,000 base pairs, and 800 to 10,000 base pairs, which have a high degree of sequence identity to the corresponding target sequence to enhance the probability of homologous recombination. The integrational elements may be any sequence that is homologous with the target sequence in the genome of the host cell. Furthermore, the integrational elements may be non-encoding or encoding polynucleotides. On the other hand, the vector may be integrated into the genome of the host cell by non-homologous recombination.

For autonomous replication, the vector can further comprise an origin of replication enabling the vector to replicate autonomously in the host cell in question. The origin of replication can be any plasmid replicator mediating autonomous replication that functions in a cell. The term "origin of replication" or "plasmid replicator" means a polynucleotide that enables a plasmid or vector to replicate in vivo.

Examples of origins of replication for use in a yeast host cell are the 2 micron origin of replication, ARS1, ARS4, the combination of ARS1 and CEN3, and the combination of ARS4 and CEN6.

Examples of origins of replication useful in a filamentous fungal cell are AMA1 and ANSI (Gems et al., 1991, Gene 98: 61-67; Cullen et al., 1987, *Nucleic Acids Res.* 15: 9163-9175; WO 00/24883). Isolation of the AMA1 gene and construction of plasmids or vectors comprising the gene can be accomplished according to the methods disclosed in WO 00/24883.

More than one copy of a polynucleotide of the present invention can be inserted into a host cell to increase production of a variant. An increase in the copy number of the polynucleotide can be obtained by integrating at least one additional copy of the sequence into the host cell genome or by including an amplifiable selectable marker gene with the polynucleotide where cells containing amplified copies of the selectable marker gene, and thereby additional copies of the polynucleotide, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

2. Codon Optimization

Codon optimization can be employed with any of the variant phytase polypeptides of the present invention, in order to optimize expression in the host cell employed. Such methods are well known in the art and described in, for example, WO 2007/142954. In heterologous expression systems, optimization steps can improve the ability of the host to produce the desired variant phytase polypeptides. Protein expression is governed by a host of factors including those that affect transcription, mRNA processing, and stability and initiation of translation. The polynucleotide optimization steps can include steps to improve the ability of the host to produce the foreign protein as well as steps to assist the researcher in efficiently designing expression constructs. Optimization strategies can include, for example, the modification of translation initiation regions, alteration of mRNA structural elements, and the use of different codon biases. The following paragraphs discuss potential problems that may result in reduced heterologous protein expression and techniques that may overcome these problems, In some embodiments, reduced heterologous protein expression results from a rare codon-induced translational pause. A rare codon-induced translational pause includes the presence of codons in the polynucleotide of interest that are rarely used in the host organism can have a negative effect on protein translation due to their scarcity in the available tRNA pool. One method of improving optimal translation in the host organism includes performing includes performing codon optimization which can result in rare host codons being modified in the synthetic polynucleotide sequence.

In some embodiments, reduced heterologous protein expression results from by alternate translational initiation. Alternate translational initiation can include a synthetic polynucleotide sequence inadvertently containing motifs capable of functioning as a ribosome binding site (RBS). These sites can result in initiating translation of a truncated protein from a gene-internal site. One method of reducing the possibility of producing a truncated protein, which can be difficult to remove during purification, includes modifying putative internal RBS sequences from an optimized polynucleotide sequence.

In some embodiments, reduced heterologous protein expression occurs through repeat-induced polymerase slippage. Repeat-induced polymerase slippage involves nucleotide sequence repeats that have been shown to cause slippage or stuttering of DNA polymerase which can result in frameshift mutations. Such repeats can also cause slippage of RNA polymerase. In an organism with a high G+C content bias, there can be a higher degree of repeats composed of G or C nucleotide repeats. Therefore, one method of reducing the possibility of inducing RNA polymerase slippage includes altering extended repeats of G or C nucleotides.

In some embodiments, reduced heterologous protein expression occurs through interfering secondary structures. Secondary structures can sequester the RBS sequence or initiation codon and have been correlated to a reduction in protein expression. Stemloop structures can also be involved in transcriptional pausing and attenuation. An optimized polynucleotide sequence can contain minimal secondary structures in the RBS and gene coding regions of the nucleotide sequence to allow for improved transcription and translation.

In some embodiments, restriction sites can effect heterologous protein expression. By modifying restriction sites that could interfere with subsequent sub-cloning of transcription units into host expression vectors a polynucleotide sequence can be optimized.

Optimizing a DNA sequence can negatively or positively affect gene expression or protein production. For example, modifying a less-common codon with a more common codon may affect the half life of the mRNA or alter its structure by introducing a secondary structure that interferes with translation of the message. It may therefore be necessary, in certain instances, to alter the optimized message.

AUG or a portion of a gene can be optimized. In some embodiments, the desired modulation of expression is achieved by optimizing essentially the entire gene. In other embodiments, the desired modulation will be achieved by optimizing part but not all of the gene.

The codon usage of any coding sequence can be adjusted to achieve a desired property, for example high levels of expression in a specific cell type. The starting point for such an optimization may be a coding sequence with 100% common codons, or a coding sequence which contains a mixture of common and non-common codons.

Two or more candidate sequences that differ in their codon usage can be generated and tested to determine if they possess the desired property. Candidate sequences can be evaluated by using a computer to search for the presence of regulatory elements, such as silencers or enhancers, and to search for the presence of regions of coding sequence which could be converted into such regulatory elements by an alteration in codon usage. Additional criteria can include enrichment for particular nucleotides, e.g., A, C, G or U, codon bias for a particular amino acid, or the presence or absence of particular mRNA secondary or tertiary structure. Adjustment to the candidate sequence can be made based on a number of such criteria.

Promising candidate sequences are constructed and then evaluated experimentally. Multiple candidates may be evaluated independently of each other, or the process can be iterative, either by using the most promising candidate as a new starting point, or by combining regions of two or more candidates to produce a novel hybrid. Further rounds of modification and evaluation can be included.

Modifying the codon usage of a candidate sequence can result in the creation or destruction of either a positive or negative element. In general, a positive element refers to any element whose alteration or removal from the candidate sequence could result in a decrease in expression of the therapeutic protein, or whose creation could result in an increase in expression of a therapeutic protein. For example, a positive element can include an enhancer, a promoter, a downstream promoter element, a DNA binding site for a positive regulator (e.g., a transcriptional activator), or a sequence responsible for imparting or modifying an mRNA secondary or tertiary structure. A negative element refers to any element whose alteration or removal from the candidate sequence could result in an increase in expression of the therapeutic protein, or whose creation would result in a decrease in expression of the therapeutic protein. A negative element includes a silencer, a DNA binding site for a negative regulator (e.g., a transcriptional repressor), a transcriptional pause site, or a sequence that is responsible for imparting or modifying an mRNA secondary or tertiary structure. In general, a negative element arises more frequently than a positive element. Thus, any change in codon usage that results in an increase in protein expression is more likely to have arisen from the destruction of a negative element rather than the creation of a positive element. In addition, alteration of the candidate sequence is more likely to destroy a positive element than create a positive element. In some embodiments, a candidate sequence is chosen and modified so as to increase the production of a therapeutic protein. The candidate sequence can be modified, e.g., by sequentially altering the codons or by randomly altering the codons in the candidate sequence. A modified candidate sequence is then evaluated by determining the level of expression of the resulting therapeutic protein or by evaluating another parameter, e.g., a parameter correlated to the level of expression. A candidate sequence which produces an increased level of a therapeutic protein as compared to an unaltered candidate sequence is chosen.

In some embodiments, one or a group of codons can be modified, e.g., without reference to protein or message structure and tested. Alternatively, one or more codons can be chosen on a message-level property, e.g., location in a region of predetermined, e.g., high or low GC content, location in a region having a structure such as an enhancer or silencer, location in a region that can be modified to introduce a structure such as an enhancer or silencer, location in a region having, or predicted to have, secondary or tertiary structure, e.g., intra-chain pairing, inter-chain pairing, location in a region lacking, or predicted to lack, secondary or tertiary structure, e.g., intra-chain or inter-chain pairing. A particular modified region is chosen if it produces the desired result.

Methods which systematically generate candidate sequences are useful. For example, one or a group, e.g., a contiguous block of codons, at various positions of a synthetic nucleic acid sequence can be modified with common codons (or with non common codons, if for example, the starting sequence has been optimized) and the resulting sequence evaluated. Candidates can be generated by optimizing (or de-optimizing) a given "window" of codons in the sequence to generate a first candidate, and then moving the window to a new position in the sequence, and optimizing (or de-optimizing) the codons in the new position under the window to provide a second candidate. Candidates can be evaluated by determining the level of expression they provide, or by evaluating another parameter, e.g., a parameter correlated to the level of expression. Some parameters can be evaluated by inspection or computationally, e.g., the possession or lack thereof of high or low GC content; a sequence element such as an enhancer or silencer; secondary or tertiary structure, e.g., intra-chain or inter-chain paring.

In some embodiments, the optimized nucleic acid sequence can express the variant phytase polypeptide of the invention, at a level which is at least 110%, 150%, 200%, 500%, 1,000%, 5,000% or even 10,000% of that expressed by nucleic acid sequence that has not been optimized Staring with the amino acid sequence of a variant phytase, a candidate DNA sequence can be designed. During the design of the synthetic DNA sequence, the frequency of codon usage can be compared to the codon usage of the host expression organism and rare host codons can be modified in the synthetic sequence. Additionally, the synthetic candidate DNA sequence can be modified in order to remove undesirable enzyme restriction sites and add or alter any desired signal sequences, linkers or untranslated regions. The synthetic DNA sequence can be analyzed for the presence of secondary structure that may interfere with the translation process, such as G/C repeats and stem-loop structures. Before the candidate DNA sequence is synthesized, the optimized sequence design can be checked to verify that the sequence correctly encodes the desired amino acid sequence. Finally, the candidate DNA sequence can be synthesized using DNA synthesis techniques, such as those known in the art.

In some embodiments, the general codon usage in a host organism, such as any of those described herein, can be utilized to optimize the expression of the heterologous polynucleotide sequence in the host organism. The percentage and distribution of codons that rarely would be considered as preferred for a particular amino acid in the host expression system can be evaluated. Values of 5% and 10% usage can be used as cutoff values for the determination of rare codons.

VII. Host Cells and Production Strains

As will be appreciated by those in the art, there are a wide variety of production host organisms for the recombinant production of the variant phytases of the invention, including, but not limited to bacterial cells and fungal cells including yeast. In addition, while the G1P parent phytase is unglycoslyated, glycosylation by production in yeast and fungi does not adversely affect the phytase activity.

The present invention also relates to recombinant host cells, comprising a polynucleotide encoding a variant glucoamlyase of the present invention operably linked to one or more control sequences that direct the production of a variant of the present invention. A construct or vector comprising a polynucleotide is introduced into a host cell so that the construct or vector is maintained as a chromosomal integrant or as a self-replicating extra-chromosomal vector as described earlier. The term "host cell" encompasses any progeny of a parent cell that is not identical to the parent cell due to mutations that occur during replication. The choice of a host cell will to a large extent depend upon the gene encoding the variant and its source. In some embodiments, the host cell exhibits transitory expression of the variant glucoamlyase. In some embodiments, the host cell is a stably transfected host or a host cell that stably (i.e., permanently) expresses the variant phytase. In some embodiments, the host cell is a production host cell.

The host cell can be any cell useful in the recombinant production of a variant, e.g., a prokaryote or a eukaryote. Such host cells include but are not limited to bacterial, fungal, and yeast cells. The host cell can also be a eukaryote, such as a mammalian, insect, plant, or fungal cell.

The host cell can be a fungal cell. "Fungi" as used herein includes the phyla Ascomycota, Basidiomycota, Chytridiomycota, and Zygomycota as well as the Oomycota and all mitosporic fungi (as defined by Hawksworth et al., In, Ainsworth and Bisby's Dictionary of The Fungi, 8th edition, 1995, CAB International, University Press, Cambridge, UK).

The fungal host cell can be a yeast cell. "Yeast" as used herein includes ascosporogenous yeast (Endomycetales), basidiosporogenous yeast, and yeast belonging to the Fungi Imperfecti (Blastomycetes). Since the classification of yeast may change in the future, for the purposes of this invention, yeast shall be defined as described in Biology and Activities of Yeast (Skinner, Passmore, and Davenport, editors, *Soc. App. Bacteriol. Symposium Series* No. 9, 1980).

The yeast host cell may be a *Candida, Hansenula, Kluyveromyces, Pichia, Saccharomyces, Schizosaccharomyces,* or *Yarrowia* cell such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis,* or *Yarrowia lipolytica* cell.

The fungal host cell may be a filamentous fungal cell. "Filamentous fungi" include all filamentous forms of the subdivision Eumycota and Oomycota (as defined by Hawksworth et al., 1995, supra). The filamentous fungi are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

The filamentous fungal host cell may be an *Acremonium, Aspergillus, Aureobasidium, Bjerkandera, Ceriporiopsis, Chrysosporium, Coprinus, Coriolus, Cryptococcus, Filibasidium, Fusarium, Humicola, Magnaporthe, Mucor, Myceliophthora, Neocallimastix, Neurospora, Paecilomyces, Penicillium, Phanerochaete, Phlebia, Piromyces, Pleurotus, Schizophyllum, Talaromyces, Thermoascus, Thielavia, Tolypocladium, Trametes,* or *Trichoderma* cell.

For example, the filamentous fungal host cell may be an *Aspergillus awamori, Aspergillus foetidus, Aspergillus fumigatus, Aspergillus japonicus, Aspergillus nidulans, Aspergillus niger, Aspergillus oryzae, Bjerkandera adusta, Ceriporiopsis aneirina, Ceriporiopsis caregiea, Ceriporiopsis gilvescens, Ceriporiopsis pannocinta, Ceriporiopsis rivulosa, Ceriporiopsis subrufa, Ceriporiopsis subvermispora, Chrysosporium inops, Chrysosporium keratinophilum, Chrysosporium lucknowense, Chrysosporium merdarium, Chrysosporium pannicola, Chrysosporium queenslandicum, Chrysosporium tropicum, Chrysosporium zonatum, Coprinus cinereus, Coriolus hirsutus, Fusarium bactridioides, Fusarium cerealis, Fusarium crookwellense, Fusarium culmorum, Fusarium graminearum, Fusarium graminum, Fusarium heterosporum, Fusarium negundi, Fusarium oxysporum, Fusarium reticulatum, Fusarium roseum, Fusarium sambucinum, Fusarium sarcochroum, Fusarium sporotrichioides, Fusarium sulphureum, Fusarium torulosum, Fusarium trichothecioides, Fusarium venenatum, Humicola insolens, Humicola lanuginosa, Mucor miehei, Myceliophthora thermophila, Neurospora crassa, Penicillium purpurogenum, Phanerochaete chrysosporium, Phlebia radiata, Pleurotus eryngii, Thielavia terrestris, Trametes villosa, Trametes versicolor,*

*Trichoderma harzianum, Trichoderma koningii, Trichoderma longibrachiatum, Trichoderma reesei,* or *Trichoderma viride* cell.

Fungal cells may be transformed by a process involving protoplast formation, transformation of the protoplasts, and regeneration of the cell wall in a manner known per se. Suitable procedures for transformation of *Aspergillus* and *Trichoderma* host cells are described in EP 238023, Yelton et al, 1984, *Proc. Natl. Acad. Sci.* USA 81: 1470-1474, and Christensen et al., 1988, *BiolTechnology* 6: 1419-1422. Suitable methods for transforming *Fusarium* species are described by Malardier et al., 1989, Gene 78: 147-156, and WO 96/00787. Yeast may be transformed using the procedures described by Becker and Guarente, In Abelson, J. N. and Simon, M. I., editors, Guide to Yeast Genetics and Molecular Biology, *Methods in Enzymology,* Volume 194, pp 182-187, Academic Press, Inc., New York; Ito et al., 1983, *J. Bacteriol.* 153: 163; and Hinnen et al., 1978, *Proc. Natl. Acad. Sci.* USA 75: 1920.

VIII. Compositions

The present invention also provides compositions comprising a variant phytases. In some embodiments, the composition comprises a carrier and/or an excipient. In some embodiments, the compositions are enriched in such a variant phytase polypeptide of the present invention. The term "enriched" indicates that the phytase activity of the composition has been increased, e.g., with an enrichment factor of at least 1. In some embodiments, the compositions are formulated to provide desirable characteristics such as low color, low odor and acceptable storage stability.

In some embodiments, the composition comprises a variant phytase polypeptide of the present invention as the major enzymatic component, e.g., a mono-component composition. In some embodiments, the composition may comprise multiple enzymatic activities, such as an aminopeptidase, alpha-amylase, beta-amylase, phytase, isoamylase, carbohydrase, carboxypeptidase, catalase, cellulase, chitinase, cutinase, cydodextrin glycosyltransferase, deoxyribonuclease, esterase, alpha-galactosidase, beta-galactosidase, phytase, alpha-glucosidase, beta-glucosidase, haloperoxidase, invertase, laccase, lipase, mannosidase, oxidase, pectinolytic enzyme, peptidoglutaminase, peroxidase, polyphenoloxidase, pullulanase, proteolytic enzyme, ribonuclease, transglutaminase, and/or xylanase.

IX. Methods of Production

The present invention also relates to methods of producing a variant phytase polypeptide, comprising: (a) cultivating a host cell of the present invention under conditions suitable for expression of the variant phytase polypeptide; and (b) optionally recovering the variant phytase polypeptide.

The host cells are cultivated in a nutrient medium suitable for production of the variant phytase polypeptide using methods known in the art. For example, the cell may be cultivated by shake flask cultivation, or small-scale or large-scale fermentation (including continuous, batch, fed-batch, or solid state fermentations) in laboratory or industrial fermentors performed in a suitable medium and under conditions allowing the variant to be expressed and/or isolated. The cultivation takes place in a suitable nutrient medium comprising carbon and nitrogen sources and inorganic salts, using procedures known in the art. Suitable media are available from commercial suppliers or can be prepared according to published compositions (e.g., in catalogues of the American Type Culture Collection). If the variant phytase polypeptide is secreted into the nutrient medium, the variant phytase polypeptide can be recovered directly from the medium. If the variant is not secreted, it can be recovered from cell lysates.

The variant phytase polypeptide can be detected using methods known in the art that are specific for the variants. These detection methods include, but are not limited to, use of specific antibodies, formation of an enzyme product, or disappearance of an enzyme substrate. For example, an enzyme assay may be used to determine the activity of the variant phytase polypeptide.

The variant phytase polypeptide can be recovered using methods known in the art. For example, the variant phytase polypeptide can be recovered from the nutrient medium by conventional procedures including, but not limited to, collection, centrifugation, filtration, extraction, spray-drying, evaporation, or precipitation.

The variant can be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., Protein Purification, Janson and Ryden, editors, VCH Publishers, New York, 1989) to obtain substantially pure variants.

In an alternative aspect, the variant is not recovered, but rather a host cell of the present invention expressing the variant is used as a source of the variant. In a particular embodiment variant phytase of the invention is not recovered and the host cell is a yeast host cell. In particular the yeast is a *Candida, Hansenula, Kluyveromyces, Pichia, Saccharomyces, Schizosaccharomyces,* or *Yarrowia* cell such as a *Kluyveromyces lactis, Saccharomyces carlsbergensis, Saccharomyces cerevisiae, Saccharomyces diastaticus, Saccharomyces douglasii, Saccharomyces kluyveri, Saccharomyces norbensis, Saccharomyces oviformis,* or *Yarrowia lipolytica* cell. In some embodiments, the yeast is *Saccharomyces cerevisiae.*

X. Phytase Formulations and Uses

As discussed herein, the use of phytase in animal feeds has a number of benefits, including a feed cost savings, such as reductions in dietary inorganic phosphate, energy and amino acids, including a fast and efficient breakdown of dietary phytate and increased nutrient availability from phytate, as well as production benefits such as body weight gain for the non-ruminant subjects, the increased release of nutrients from phytate, and a significant benefit in the reduced phosphorus excretion to improve the environmental impacts of non-ruminant animals. In some embodiments, the variant phytases of the invention are formulated and added to feed or can be made as a component of the feed. In the former case, the feed stock addition of phytase can be done by formulating the phytase on a carrier feed such as wheat flour.

As will be appreciated by those in the art, the formulation of the variant phytases of the invention depends on its end use and the associated conditions. Suitable formulations for the variant phytases of the invention include liquid formulations, dried formulations (including spray dried formulations), powdered formulations, granular formulations, and pelleted formulations.

In some embodiments, the enzyme composition (i.e., polypeptide compositions) of the present invention can be in any form suitable for use, such as, for example, a crude fermentation broth with or without cells removed, a cell lysate with or without cellular debris, a semi-purified or purified enzyme composition, or a host cell, as a source of the enzymes.

In some embodiments, the enzyme composition can be a dry powder or granulate, a non-dusting granulate, a liquid, a stabilized liquid, or a stabilized protected enzyme. Liquid enzyme compositions may, for instance, be stabilized by adding stabilizers such as a sugar, a sugar alcohol or another polyol, and/or lactic acid or another organic acid according to established processes.

In some embodiments, the dosage of the polypeptide composition of the invention and other conditions under which the composition is used may be determined on the basis of methods known in the art.

The above compositions are suitable for use in liquefaction, saccharification, and/or fermentation processes, and in some embodiments, in starch conversion. In some embodiments, the compositions are useful for producing a food product, including a syrup, as well as fermentation products, such as ethanol. In some embodiments, the compositions are useful for the pharmaceutical industry, such as digestive aids.

In one embodiment, the phytases are added to animal feed stock and pelleted as is known in the art, such that the feed is formed with phytase in it. In other embodiments, the phytase can be sprayed or dosed in a liquid form into animal feed.

EXAMPLES

XI. Example 1: Gene Synthesis and Cloning

The starting gene of EcPhytase (G1P) was synthesized by GenScript (http://www.genscript.com/). The synthesized gene was cloned into the pET-20b(+) vector (Novagen EMD Millipore, USA: catalogue #69739).

XII. Example 2: Mutant Collection Design and Construction

In the first generation of improvement, a native Phytase gene (G1P, SEQ ID NO:1) from an *E. coli* strain was used as the parent. To improve the thermostability and pH tolerance of the Generation 1 parent, eight mutant collections were designed based on protein sequence and structural analysis of EcPhytase. The design includes one to multiple specific mutations per variant. The mutant collections were constructed using the QuickChange® Lightning kit (Agilent Technologies, Santa Clara, Calif.) and subsequently cloned into the pET-20b(+) vector (Novagen EMD Millipore, USA: catalogue #69739).

In the second generation of improvement, the best variant from the first generation was used as the parent. To further improve the thermostability and pH tolerance of the Generation 2 parent, two mutant collections were designed based on the favorable mutations identified in the first generation. The design includes one to multiple specific mutations per variant. The mutant collections were subsequently constructed using the QuickChange® Lightning kit (Agilent Technologies, Santa Clara, Calif.).

In the third generation of improvement, the best variant from the second generation was used as the parent. To further improve the thermostability and pH tolerance of the Generation 3 parent, one mutant collection was designed based on the favorable mutations identified in the first and second generations. The design includes one to multiple specific mutations per variant. The mutant collections were subsequently constructed using the QuickChange® Lightning kit (Agilent Technologies, Santa Clara, Calif.).

XIII. Example 3: Preparation of HTP Phytase-Containing Wet Cell Pellets

BL21(DE3)pLysS *E. coli* cells (Thermo Fisher Scientific, USA: Catalogue # C606003) comprising recombinant phytase-encoding genes from single colonies were inoculated into individual wells of 96 wells shallow microtiter plates holding 1800 LB containing 1% glucose and 100 µg/mL ampicillin. The cultures were grown overnight at 30° C., 200 rpm and 85% humidity. 10 µL of the overnight culture from each well was transferred into the corresponding wells of 96 deep well plates containing 390 mL Terrific Broth (TB) and 100 µg/mL ampicillin. The deep-well plates were incubated for 3.5-4 hours (OD600 0.6-0.8) at 37° C., 250 rpm and 85% humidity. The cell cultures were then induced by IPTG to a final concentration of 1 mM and incubated overnight under the same conditions as originally used. The cells were then pelleted using centrifugation at 4000 rpm for 10 min at 4° C. The supernatants were discarded and the pellets frozen at −80° C. prior to lysis.

XIV. Example 4: Lysis of the HTP Phytase Plates

150 µL of B-PER bacterial protein extraction reagent (Thermo Fisher Scientific, USA: Catalogue #78248) was added to the cell paste in each well as described above. The cells were lysed at room temperature for 1.5 hours with shaking on a bench top shaker. The plate was then centrifuged for 10 min at 4000 rpm and 4° C. The clear supernatants were used to perform biochemical assays to determine activity, pH tolerance and thermostability.

XV. Example 5: Enzymatic Assay without Temperature Treatment

The lysate from example 4 was 400 fold diluted using 0.1M sodium acetate, pH 4.5 and pH 5.5. In 96 well shallow microtiter plates, 30 µl of the diluted lysate was added to 20 µl of sodium phytate substrate ($C_6H_6Na_{12}O_{24}P_6$, FW: 923.81) prepared in 0.1M sodium acetate, pH 4.5 and pH 5.5. The reaction was incubated at 24° C., 150 rpm for 30 minutes. The reaction was quenched with 50 µl of 5% w/v trichloroacetic acid. To each well of the 96 well shallow microtiter plates, 100 µl of coloring reagent was added. The coloring reagent was freshly prepared by mixing four volumes of 2.5% ammonium molybdate solution in 5.5% sulfuric acid and one volume of 2.7% ferrous sulfate solution. After shaking the plates for 30 seconds, they were subjected to centrifugation at 400 µl rpm for 2 minutes. 100 µl of the supernatant from each well of the centrifuged plates was then diluted with 100 µl of water and absorbance read at 700 nm. The enzyme activity of variant was compared to the parent under the same conditions to determine activity improvement (FIGS. 5 and 6).

XVI. Example 6: Enzymatic Assay with Temperature Treatment

The lysate from example 4 was 90 fold diluted using 0.1M sodium acetate, pH 4.5 and pH 5.5. 50 µl of the diluted lysate was transferred to PCR plates and heated at 58° C. or 66° C. (G1), 66° C. (G2), and 70.2° C. (G3) for 5 minutes in thermocyders to identify improved variants. In 96 well shallow microtiter plates, 30 μl of the treated lysate was added to 20 μl of sodium phytate substrate ($C_6H_6Na_{12}O_{24}P_6$, FW: 923.81) prepared in 0.1M sodium acetate, pH 5.5. The reaction was incubated at 37° C., 150 rpm for 30 minutes. The reaction was quenched with 50 μl of 5% w/v trichloroacetic acid. To each well of the 96 well shallow microtiter plates, 100 μl of coloring reagent was added. The coloring reagent was freshly prepared by mixing four volumes of 2.5% ammonium molybdate solution in 5.5% sulfuric acid and one volume of 2.7% ferrous sulfate solution. After shaking the plates for 30 seconds, they were subjected to centrifugation at 400 μl rpm for 2 minutes. 100 μl of the supernatant from each well of the centrifuged plates was then diluted with 100 μl of water and absorbance read at 700 nm. After pH/Temperature treatment, the enzyme activity of variant was compared to the parent under the same conditions to determine improvement in pH tolerance and thermostability. The best generation 1 variant G2P showed 12 and 20-fold improvement over the generation 1 parent G1P at pH 4.5 and pH 5.5 respectively (FIG. 6). The best generation 2 variant G3P showed 2-fold improvement over the generation 2 parent G2P at pH 5.5 (FIG. 7). The best generation 3 variant G4P showed 4-fold improvement over the generation 3 parent G3P at pH 5.5 (FIG. 8).

XVII. Example 7: Validation of the Variants in Temperature Gradient Assay

Figure 10B:
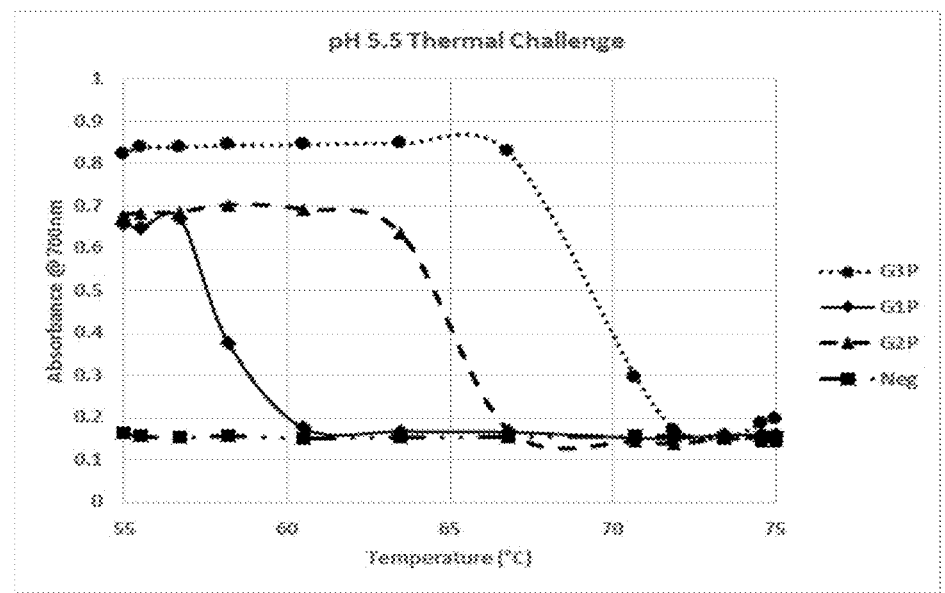
Figure 12:
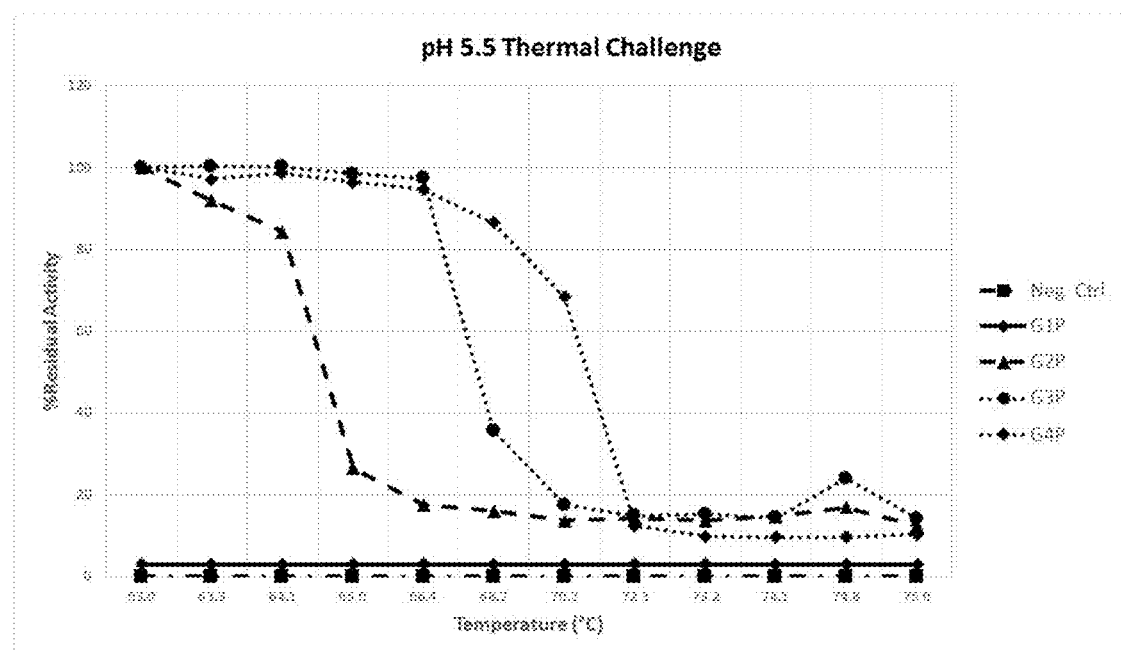
FIG. 12 shows the thermal challenge of selected sequences (including G1P, G2P, G3P and G4P). The thermal challenge was a 5-minute challenge at the indicated temperature as discussed in Example 7. % Residual Activity is calculated as [(activity of variant at any temperature)/(activity of variant at 63.0° C.)×100%].

The top variants from each generation were selected based on improved pH tolerance and thermostability. The best variants were then subjected to a temperature gradient treatment in the range of 55° C.-75° C. or 63° C.-75° C. for 5 minutes at pH 4.5 and/or 5.5 following the protocol described in example 6. FIG. 10 shows the thermostability profile of G1P, G2P and G3P variants at pH 4.5 and 5.5 respectively. Under both pHs, G1P maintains 100% activity till 57° C. G2P maintains 100% activity till 64° C., whereas G3P is stable up to 68° C. FIG. 12 shows the thermostability profile of G1P, G2P, G3P and G4P variants at pH 5.5 respectively.

SEQUENCE LISTING (332 sequences)

SEQ ID NO: 1 - protein, 410 aa, Artificial Sequence
  Synthetic Phytase (CL00000004 G1P protein)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 2 - protein, 22 aa, Artificial Sequence
  Synthetic Phytase (endogeneous signal sequence protein)
MKAILIPFLSLLIPLTPQSAFA

SEQ ID NO: 3 - DNA, 1230 bp, Artificial Sequence
  Synthetic Phytase (CL0000004 G1P)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 4 - DNA, 66 bp, Artificial Sequence
  Synthetic Phytase (CL00000004 EcPhytase G1P signal)
atgaaagcgatcttaatcccatttttatctcttctgattccgttaaccccgcaatctgcattcgct

SEQ ID NO: 5 - protein, 410 aa, Artificial Sequence
  Synthetic Phytase (CL00000430 EcPhytase G2P protein)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 6 - DNA, 1230 bp, Artificial Sequence
  Synthetic Phytase (CL00000430 EcPhytase G2P)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 7 - protein, 410 aa, Artificial Sequence
  Synthetic Phytase (CL00005023 EcPhytase G3P)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 8 - DNA, 1230 bp, Artificial Sequence
  Synthetic Phytase (CL00005023 EcPhytase G3P)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 9 - protein, 410 aa, Artificial Sequence
  Synthetic Phytase (CL00014818 EcPhytase G4P protein)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPAAVTDAILSRAGGSIADFTQHYQTAFRELERVLNFPQSKLCFNREKQNESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNDARIPACSL

SEQ ID NO: 10 - DNA, 1230 bp, Artificial Sequence
  Synthetic Phytase (CL00014818 EcPhytase G4P)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctgctgttactgacgctatcttgtccagagctggaggatccattgctgacttcacccaacactaccagactgccttcagagagttggaaagagttcttaacttcccacaatccaagttgtgctttaaccgtgagaagcaaaacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgatgctagaatcccagcttgttccttg

SEQ ID NO: 11 - protein, 410 aa, Artificial Sequence; identical to SEQ ID NO: 1
  Synthetic Phytase (CL00000004 EcPhytase G1P)

SEQ ID NO: 12 - protein, 410 aa, Artificial Sequence
  Synthetic Phytase (CL00000108)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGITLPTSLLFIAGHDTNLANLSGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 13 - protein, 410 aa, Artificial Sequence
  Synthetic Phytase (CL00000144)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLSGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 14 - protein, 410 aa, Artificial Sequence
  Synthetic Phytase (CL00000157)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPAWGRITDSHQWNTLLSLHNAQFDLLQRTPEVARSRATPLLDLIMAALTPHPPQKQAYGITLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 15 - protein, 410 aa, Artificial Sequence
  Synthetic Phytase (CL00000187)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFLAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 16 - protein, 410 aa, Artificial Sequence
  Synthetic Phytase (CL00000216)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGITLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 17 - protein, 410 aa, Artificial Sequence
  Synthetic Phytase (CL00000223)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 18 - protein, 410 aa, Artificial Sequence
  Synthetic Phytase (CL00000231)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGITLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 19 - protein, 410 aa, Artificial Sequence
  Synthetic Phytase (CL00000239)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGITLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 20 - protein, 410 aa, Artificial Sequence
  Synthetic Phytase (CL00000264)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFLAGLAPDCAITVHTQADTSSPDPLFNPLKTGVCQLDNANVTDAILSRAGGSIADFTGHYQTAFRELERVLNFPQSNLCFNREKQDESCTLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPISVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 21 - protein, 410 aa, Artificial Sequence
  Synthetic Phytase (CL00000266)
QSEPELKLESVVIVSRHGVRAPTKATQLMKDVTPDAWPTWPVKLGWLTPRGGELIAYLGHYQRQRLVADGLLAKKGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLPGCEERNAQGMCSLAGFTQIVNEARIPACSL

SEQ ID NO: 22 - protein, 410 aa, Artificial Sequence
  Synthetic Phytase (CL00000313)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 23 - protein, 410 aa, Artificial Sequence
  Synthetic Phytase (CL00000317)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCTLTQALPSELKVSADNVSLTGAVSLASMLTEIFLLQQAQGMPEPAWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 24 - protein, 410 aa, Artificial Sequence
  Synthetic Phytase (CL00000360)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCTLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSLLFIAGHDTNLANLSGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 25 - protein, 410 aa, Artificial Sequence
  Synthetic Phytase (CL00000374)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 26 - protein, 410 aa, Artificial Sequence
  Synthetic Phytase (CL00000387)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFLAGLAPDCAITVHTQADTSSPDPLFNPLKTGVCQLDNANVTDAILSRAGGSIADFTQHRQTAFRELERVLNFPQSNLCFNREKQDESCSLTQALPSELKVSADNVSLTGAVSLASMLTEIFLLQQAQGMPEPAWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 27 - protein, 410 aa, Artificial Sequence
  Synthetic Phytase (CL00000391)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGITLPTSLLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 28 - protein, 410 aa, Artificial Sequence
  Synthetic Phytase (CL00000408)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHYQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 29 - protein, 410 aa, Artificial Sequence
  Synthetic Phytase (CL00000420)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 30 - protein, 410 aa, Artificial Sequence; identical to SEQ ID NO: 5
  Synthetic Phytase (CL00000430 EcPhytase G2P)

SEQ ID NO: 31 - protein, 410 aa, Artificial Sequence
  Synthetic Phytase (CL00000432)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSLLFIAGHDTNLANLGGALELNWTLPGQPDNTPPGGELVFERWRRLSDNSQWIQVSLVFQTLQQMRDKTPLSLNTPPGEVKLTLPGCEERNAQGMCSLAGFTQIVNEARIPACSL

SEQ ID NO: 32 - protein, 410 aa, Artificial Sequence
  Synthetic Phytase (CL00000528)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFLAGLAPDCAITVHTQADTSSPDPLFNPLKTGVCQLDNANVTDAILSRAGGSIADFTQHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSLLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 33 - protein, 410 aa, Artificial Sequence
  Synthetic Phytase (CL00000565)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFLAGLAPDCAITVHTQADTSSPDPLFNPLKTGVCQLDNANVTDAILSRAGGSIADFTQHRQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 34 - protein, 410 aa, Artificial Sequence
  Synthetic Phytase (CL00000588)
QSEPELKLESVVIVSRHGVRAPTKATQLMQDVTPDAWPTWPVKLGWLTPRGGELVAYLGHYQRQRLVADGLLAKKGCPQPGQVAVIADVDERTRKTGEAFLAGLAPDCAITVHTQADTSSPDPLFNPLKTGVCQLDNANVTDAILSRAGGSIADFTGHYQTAFRELERVLNFPQSNLCFNREKQDESCTLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLAGCEERNAQGMCSLAGFTQIVNEARIPACSL

SEQ ID NO: 35 - protein, 410 aa, Artificial Sequence
  Synthetic Phytase (CL00000605)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVEDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 36 - protein, 410 aa, Artificial Sequence
  Synthetic Phytase (CL00000624)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVGDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 37 - protein, 410 aa, Artificial Sequence
  Synthetic Phytase (CL00000625)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILRRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 38 - protein, 410 aa, Artificial Sequence
  Synthetic Phytase (CL00000647)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVADAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 39 - protein, 410 aa, Artificial Sequence
  Synthetic Phytase (CL00000663)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDSANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 40 - protein, 410 aa, Artificial Sequence
  Synthetic Phytase (CL00000690)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTNHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 41 - protein, 410 aa, Artificial Sequence
  Synthetic Phytase (CL00000715)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVRDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 42 - protein, 410 aa, Artificial Sequence
  Synthetic Phytase (CL00000716)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTLHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 43 - protein, 410 aa, Artificial Sequence
  Synthetic Phytase (CL00000721)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTRHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 44 - protein, 410 aa, Artificial Sequence
  Synthetic Phytase (CL00000774)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTAHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 45 - protein, 410 aa, Artificial Sequence
  Synthetic Phytase (CL00000835)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDPANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 46 - protein, 410 aa, Artificial Sequence
  Synthetic Phytase (CL00000872)
SSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 47 - protein, 410 aa, Artificial Sequence
  Synthetic Phytase (CL00001018)
VSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 48 - protein, 410 aa, Artificial Sequence
  Synthetic Phytase (CL00001019)
QSEPELKLESVVIVSRHGVRAPTKATQLMQDVTPDKWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 49 - protein, 410 aa, Artificial Sequence
  Synthetic Phytase (CL00001052)
QSEPELKLESVVIVSRHGVRAPTKATQLMQDVTPDAWPDWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 50 - protein, 410 aa, Artificial Sequence
  Synthetic Phytase (CL00001132)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSRPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 51 - protein, 410 aa, Artificial Sequence
  Synthetic Phytase (CL00001154)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADRSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 52 - protein, 410 aa, Artificial Sequence
  Synthetic Phytase (CL00001170)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCDITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 53 - protein, 410 aa, Artificial Sequence
  Synthetic Phytase (CL00001177)
QSEPELKLESVVIVSRHGVRAPTKATQLMQDVTPDAWPTWPVKLGWLTPRGGELIAYLGHYQRQRLVADGLLAKKGCPLPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 54 - protein, 410 aa, Artificial Sequence
  Synthetic Phytase (CL00001243)
QSEPELKLESVVIVSRHGVRAPTKATQLMQDVTPDAWPTWPVKLGWLTPRGGELIAYLGHYQRQRLVADGLLDKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 55 - protein, 410 aa, Artificial Sequence
  Synthetic Phytase (CL00001286)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADSSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 56 - protein, 410 aa, Artificial Sequence
  Synthetic Phytase (CL00001294)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQYDTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 57 - protein, 410 aa, Artificial Sequence
  Synthetic Phytase (CL00001316)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAIDVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 58 - protein, 410 aa, Artificial Sequence
  Synthetic Phytase (CL00001342)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCEITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 59 - protein, 410 aa, Artificial Sequence
  Synthetic Phytase (CL00001352)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQPDTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 60 - protein, 410 aa, Artificial Sequence
  Synthetic Phytase (CL00001366)
QSEPELKLESVVIVSRHGVRAPTKATQLMQDVTPDAWPTWPVKLGWLTPRGGELIAYLGHYQRQRLVADGLLADKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 61 - protein, 410 aa, Artificial Sequence
  Synthetic Phytase (CL00001389)
QSEPELKLESVVIVSRHGVRAPTKATQLMQDVTPDAWPTWPVKLGWLTPRGGELIAYLGQYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 62 - protein, 410 aa, Artificial Sequence
  Synthetic Phytase (CL00001394)
QSEPELKLESVVIVSRHGVRAPTKATQLMQDVTPDAWPTWPVKLGWLTPRGGELIAYLGHYQRQRLVADGLLAPKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 63 - protein, 410 aa, Artificial Sequence
  Synthetic Phytase (CL00001416)
QSEPELKLESVVIVSRHGVRAPTKATQLMQDVTPDAWPTWPVKLGWLTPRGGELIAYLGSYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 64 - protein, 410 aa, Artificial Sequence
  Synthetic Phytase (CL00001428)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQRDTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 65 - protein, 410 aa, Artificial Sequence
  Synthetic Phytase (CL00001446)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAIQVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 66 - protein, 410 aa, Artificial Sequence
  Synthetic Phytase (CL00001522)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNVNVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 67 - protein, 410 aa, Artificial Sequence
  Synthetic Phytase (CL00001543)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCFITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 68 - protein, 410 aa, Artificial Sequence
  Synthetic Phytase (CL00001591)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCPITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 69 - protein, 410 aa, Artificial Sequence
  Synthetic Phytase (CL00001592)
QSEPELKLESVVIVSRHGVRAPTKATQLMQDVTPDAWPTWPVKLGWLTPRGGELIAYLGHYQRQRLVADGLLAKKGCPFPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 70 - protein, 410 aa, Artificial Sequence
  Synthetic Phytase (CL00001593)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNHNVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 71 - protein, 410 aa, Artificial Sequence
  Synthetic Phytase (CL00001608)
QSEPELKLESVVIVSRHGVRAPTKATQLMQDVTPDAWPTWPVKLGWLTPRGGELIAYLGHYQRQRLVANGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 72 - protein, 410 aa, Artificial Sequence
  Synthetic Phytase (CL00004927)
QSEPELKLESVVIVSRHGVRAPTKATQLMQDVTPDAWPTWPVKLGWLTPRGGELVAYLGSYQRQRLVANGLLAKKGCPQPGQVAIIADVDERTRKTGEAFAAGLAPDCAIDVHTQADTSSPDPLFNPLKTGVCQLDPANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 73 - protein, 410 aa, Artificial Sequence
  Synthetic Phytase (CL00004928)
QSEPELKLESVVIVSRHGVRAPTKATQLMQDVTPDAWPDWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDSANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 74 - protein, 410 aa, Artificial Sequence
  Synthetic Phytase (CL00004930)
QSEPELKLESVVIVSRHGVRAPTKATQLMQDVTPDAWPTWPVKLGWLTPRGGELVAYLGQYQRQRLVANGLLAKKGCPQPGQVAIIADVDERTRKTGEAFAAGLAPDCAITVHTQADTSSPDPLFNPLKTGVCQLDPVNVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 75 - protein, 410 aa, Artificial Sequence
  Synthetic Phytase (CL00004936)
QSEPELKLESVVIVSRHGVRAPTKATQLMQDVTPDAWPDWPVKLGWLTPRGGELVAYLGHYQRQRLVANGLLADKGCPQPGQVAIIADVDERTRKTGEAFAAGLAPDCAITVHTQADTSSPDPLFNPLKTGVCQLDPVNVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 76 - protein, 410 aa, Artificial Sequence
  Synthetic Phytase (CL00004938)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAIDVHTQADTSSPDPLFNPLKTGVCQLDNANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 77 - protein, 410 aa, Artificial Sequence
  Synthetic Phytase (CL00004940)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDSVNVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 78 - protein, 410 aa, Artificial Sequence
  Synthetic Phytase (CL00004948)
QSEPELKLESVVIVSRHGVRAPTKATQLMQDVTPDAWPTWPVKLGWLTPRGGELVAYLGQYQRQRLVADGLLAPKGCPQPGQVAIIADVDERTRKTGEAFAAGLAPDCAITVHTQADTSSPDPLFNPLKTGVCQLDSANVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 79 - protein, 410 aa, Artificial Sequence
  Synthetic Phytase (CL00004951)
QSEPELKLESVVIVSRHGVRAPTKATQLMQDVTPDAWPTWPVKLGWLTPRGGELVAYLGHYQRQRLVANGLLAPKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 80 - protein, 410 aa, Artificial Sequence
  Synthetic Phytase (CL00004954)
QSEPELKLESVVIVSRHGVRAPTKATQLMQDVTPDAWPTWPVKLGWLTPRGGELVAYLGQYQRQRLVADGLLAPKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 81 - protein, 410 aa, Artificial Sequence
  Synthetic Phytase (CL00004962)
QSEPELKLESVVIVSRHGVRAPTKATQLMQDVTPDAWPDWPVKLGWLTPRGGELVAYLGHYQRQRLVADGLLAKKGCPQPGQVAIIADVDERTRKTGEAFAAGLAPDCAIDVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 82 - protein, 410 aa, Artificial Sequence
  Synthetic Phytase (CL00004963)
QSEPELKLESVVIVSRHGVRAPTKATQLMQDVTPDAWPDWPVKLGWLTPRGGELVAYLGQYQRQRLVADGLLADKGCPQPGQVAIIADVDERTRKTGEAFAAGLAPDCAIDVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 83 - protein, 410 aa, Artificial Sequence
  Synthetic Phytase (CL00004967)
QSEPELKLESVVIVSRHGVRAPTKATQLMQDVTPDAWPDWPVKLGWLTPRGGELVAYLGHYQRQRLVANGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 84 - protein, 410 aa, Artificial Sequence
  Synthetic Phytase (CL00004970)
QSEPELKLESVVIVSRHGVRAPTKATQLMQDVTPDAWPTWPVKLGWLTPRGGELVAYLGHYQRQRLVANGLLADKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 85 - protein, 410 aa, Artificial Sequence
  Synthetic Phytase (CL00004976)
QSEPELKLESVVIVSRHGVRAPTKATQLMQDVTPDAWPDWPVKLGWLTPRGGELVAYLGQYQRQRLVANGLLAKKGCPQPGQVAIIADVDERTRKTGEAFAAGLAPDCAITVHTQADTSSPDPLFNPLKTGVCQLDSVNVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 86 - protein, 410 aa, Artificial Sequence
  Synthetic Phytase (CL00004977)
QSEPELKLESVVIVSRHGVRAPTKATQLMQDVTPDAWPDWPVKLGWLTPRGGELVAYLGHYQRQRLVADGLLADKGCPQPGQVAIIADVDERTRKTGEAFAAGLAPDCAITVHTQADTSSPDPLFNPLKTGVCQLDNANVTDAILSRAGGSIADFTAHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 87 - protein, 410 aa, Artificial Sequence
  Synthetic Phytase (CL00004979)
QSEPELKLESVVIVSRHGVRAPTKATQLMQDVTPDAWPDWPVKLGWLTPRGGELVAYLGQYQRQRLVADGLLADKGCPQPGQVAIIADVDERTRKTGEAFAAGLAPDCAITVHTQADTSSPDPLFNPLKTGVCQLDPANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 88 - protein, 410 aa, Artificial Sequence
  Synthetic Phytase (CL00004981)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 89 - protein, 410 aa, Artificial Sequence
  Synthetic Phytase (CL00004983)
QSEPELKLESVVIVSRHGVRAPTKATQLMQDVTPDAWPDWPVKLGWLTPRGGELVAYLGHYQRQRLVANGLLAKKGCPQPGQVAIIADVDERTRKTGEAFAAGLAPDCAITVHTQADTSSPDPLFNPLKTGVCQLDPANVEDAILSRAGGSIADFTAHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 90 - protein, 410 aa, Artificial Sequence
  Synthetic Phytase (CL00004990)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSRPDPLFNPLKTGVCQLDPVNVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 91 - protein, 410 aa, Artificial Sequence
  Synthetic Phytase (CL00004994)
QSEPELKLESVVIVSRHGVRAPTKATQLMQDVTPDAWPDWPVKLGWLTPRGGELVAYLGQYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 92 - protein, 410 aa, Artificial Sequence
  Synthetic Phytase (CL00004998)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAITVHTQADTSSPDPLFNPLKTGVCQLDNANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 93 - protein, 410 aa, Artificial Sequence
  Synthetic Phytase (CL00005001)
QSEPELKLESVVIVSRHGVRAPTKATQLMQDVTPDAWPTWPVKLGWLTPRGGELVAYLGHYQRQRLVADGLLAPKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 94 - protein, 410 aa, Artificial Sequence
  Synthetic Phytase (CL00005002)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDPVNVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 95 - protein, 410 aa, Artificial Sequence
  Synthetic Phytase (CL00005012)
QSEPELKLESVVIVSRHGVRAPTKATQLMQDVTPDAWPTWPVKLGWLTPRGGELVAYLGQYQRQRLVANGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 96 - protein, 410 aa, Artificial Sequence
  Synthetic Phytase (CL00005013)
QSEPELKLESVVIVSRHGVRAPTKATQLMQDVTPDAWPDWPVKLGWLTPRGGELVAYLGHYQRQRLVANGLLADKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 97 - protein, 410 aa, Artificial Sequence; identical to SEQ ID NO: 7
  Synthetic Phytase (CL00005023 EcPhytase G3P)

SEQ ID NO: 98 - protein, 410 aa, Artificial Sequence
  Synthetic Phytase (CL00005041)
QSEPELKLESVVIVSRHGVRAPTKATQLMQDVTPDAWPTWPVKLGWLTPRGGELVAYLGHYQRQRLVANGLLAKKGCPQPGQVAIIADVDERTRKTGEAFAAGLAPDCAITVHTQADTSSPDPLFNPLKTGVCQLDPVNVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 99 - protein, 410 aa, Artificial Sequence
  Synthetic Phytase (CL00005054)
QSEPELKLESVVIVSRHGVRAPTKATQLMQDVTPDAWPDWPVKLGWLTPRGGELVAYLGHYQRQRLVANGLLAPKGCPQPGQVAIIADVDERTRKTGEAFAAGLAPDCAIDVHTQADTSRPDPLFNPLKTGVCQLDNANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 100 - protein, 410 aa, Artificial Sequence
  Synthetic Phytase (CL00005064)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDPANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 101 - protein, 410 aa, Artificial Sequence
  Synthetic Phytase (CL00005080)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDPVNVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 102 - protein, 410 aa, Artificial Sequence
  Synthetic Phytase (CL00005081)
QSEPELKLESVVIVSRHGVRAPTKATQLMQDVTPDAWPDWPVKLGWLTPRGGELVAYLGHYQRQRLVADGLLADKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 103 - protein, 410 aa, Artificial Sequence
  Synthetic Phytase (CL00005083)
QSEPELKLESVVIVSRHGVRAPTKATQLMQDVTPDAWPDWPVKLGWLTPRGGELVAYLGSYQRQRLVADGLLAKKGCPQPGQVAIIADVDERTRKTGEAFAAGLAPDCAIDVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 104 - protein, 410 aa, Artificial Sequence
  Synthetic Phytase (CL00005086)
QSEPELKLESVVIVSRHGVRAPTKATQLMQDVTPDAWPDWPVKLGWLTPRGGELVAYLGSYQRQRLVANGLLAKKGCPQPGQVAIIADVDERTRKTGEAFAAGLAPDCAITVHTQADTSRPDPLFNPLKTGVCQLDSANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 105 - protein, 410 aa, Artificial Sequence
  Synthetic Phytase (CL00005181)
QSEPELKLESVVIVSRHGVRAPTKATQLMQDVTPDAWPTWPVKLGWLTPRGGELVAYLGQYQRQRLVADGLLAKKGCPQPGQVAIIADVDERTRKTGEAFAAGLAPDCAITVHTQADTSSPDPLFNPLKTGVCQLDPVNVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 106 - protein, 410 aa, Artificial Sequence
  Synthetic Phytase (CL00005230)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTLHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 107 - protein, 410 aa, Artificial Sequence
  Synthetic Phytase (CL00005241)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSRPDPLFNPLKTGVCQLDPANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 108 - protein, 410 aa, Artificial Sequence
  Synthetic Phytase (CL00005248)
QSEPELKLESVVIVSRHGVRAPTKATQLMQDVTPDAWPTWPVKLGWLTPRGGELVAYLGQYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 109 - protein, 410 aa, Artificial Sequence
  Synthetic Phytase (CL00005267)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 110 - protein, 410 aa, Artificial Sequence
  Synthetic Phytase (CL00005313)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSRPDPLFNPLKTGVCQLDSVNVTDAILSRAGGSIADFTLHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 111 - protein, 410 aa, Artificial Sequence
  Synthetic Phytase (CL00005417)
QSEPELKLESVVIVSRHGVRAPTKATQLMQDVTPDAWPDWPVKLGWLTPRGGELVAYLGHYQRQRLVANGLLAKKGCPQPGQVAIIADVDERTRKTGEAFAAGLAPDCAITVHTQADTSRPDPLFNPLKTGVCQLDNANVADAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 112 - protein, 410 aa, Artificial Sequence
  Synthetic Phytase (CL00005517)
QSEPELKLESVVIVSRHGVRAPTKATQLMQDVTPDAWPTWPVKLGWLTPRGGELVAYLGSYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 113 - protein, 410 aa, Artificial Sequence
  Synthetic Phytase (CL00005529)
QSEPELKLESVVIVSRHGVRAPTKATQLMQDVTPDAWPDWPVKLGWLTPRGGELVAYLGHYQRQRLVADGLLAKKGCPQPGQVAIIADVDERTRKTGEAFAAGLAPDCAITVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 114 - protein, 410 aa, Artificial Sequence
  Synthetic Phytase (CL00005540)
QSEPELKLESVVIVSRHGVRAPTKATQLMQDVTPDAWPDWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 115 - protein, 410 aa, Artificial Sequence
  Synthetic Phytase (CL00005550)
QSEPELKLESVVIVSRHGVRAPTKATQLMQDVTPDAWPTWPVKLGWLTPRGGELVAYLGSYQRQRLVADGLLADKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 116 - protein, 410 aa, Artificial Sequence
  Synthetic Phytase (CL00005552)
QSEPELKLESVVIVSRHGVRAPTKATQLMQDVTPDAWPDWPVKLGWLTPRGGELVAYLGHYQRQRLVADGLLAKKGCPQPGQVAIIADVDERTRKTGEAFAAGLAPDCAIDVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 117 - protein, 410 aa, Artificial Sequence
  Synthetic Phytase (CL00005563)
QSEPELKLESVVIVSRHGVRAPTKATQLMQDVTPDAWPDWPVKLGWLTPRGGELVAYLGSYQRQRLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 118 - protein, 410 aa, Artificial Sequence
  Synthetic Phytase (CL00005570)
QSEPELKLESVVIVSRHGVRAPTKATQLMQDVTPDAWPDWPVKLGWLTPRGGELVAYLGHYQRQRLVADGLLADKGCPQPGQVAIIADVDERTRKTGEAFAAGLAPDCAITVHTQADTSSPDPLFNPLKTGVCQLDNANVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 119 - protein, 410 aa, Artificial Sequence
  Synthetic Phytase (CL00005572)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAIDVHTQADTSSPDPLFNPLKTGVCQLDNANVEDAILSRAGGSIADFTNHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 120 - protein, 410 aa, Artificial Sequence
  Synthetic Phytase (CL00005573)
QSEPELKLESVVIVSRHGVRAPTKATQLMQDVTPDAWPTWPVKLGWLTPRGGELVAYLGSYQRQRLVADGLLADKGCPQPGQVAIIADVDERTRKTGEAFAAGLAPDCAIDVHTQADTSRPDPLFNPLKTGVCQLDNANVEDAILSRAGGSIADFTNHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 121 - protein, 410 aa, Artificial Sequence
  Synthetic Phytase (CL00005579)
QSEPELKLESVVIVSRHGVRAPTKATQLMQDVTPDAWPDWPVKLGWLTPRGGELVAYLGHYQRQRLVADGLLADKGCPQPGQVAIIADVDERTRKTGEAFAAGLAPDCAITVHTQADTSRPDPLFNPLKTGVCQLDNANVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 122 - protein, 410 aa, Artificial Sequence
  Synthetic Phytase (CL00005587)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAITVHTQADTSSPDPLFNPLKTGVCQLDNANVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 123 - protein, 410 aa, Artificial Sequence
  Synthetic Phytase (CL00005590)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAITVHTQADTSRPDPLFNPLKTGVCQLDNANVTDAILSRAGGSIADFTNHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 124 - protein, 410 aa, Artificial Sequence
  Synthetic Phytase (CL00005621)
QSEPELKLESVVIVSRHGVRAPTKATQLMQDVTPDAWPTWPVKLGWLTPRGGELVAYLGHYQRQRLVADGLLADKGCPQPGQVAIIADVDERTRKTGEAFAAGLAPDCAITVHTQADTSRPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 125 - protein, 410 aa, Artificial Sequence
  Synthetic Phytase (CL00005625)
QSEPELKLESVVIVSRHGVRAPTKATQLMQDVTPDAWPTWPVKLGWLTPRGGELVAYLGHYQRQRLVADGLLAKKGCPQPGQVAIIADVDERTRKTGEAFAAGLAPDCAIDVHTQADTSRPDPLFNPLKTGVCQLDNANVEDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 126 - protein, 410 aa, Artificial Sequence
  Synthetic Phytase (CL00005677)
QSEPELKLESVVIVSRHGVRAPTKATQLMQDVTPDAWPTWPVKLGWLTPRGGELVAYLGSYQRQHLVADGLLAKKGCPQPGQVAIIADVDERTRKTGEAFAAGLAPDCAITVHTQADTSSPDPLFNPLKTGVCQLDNANVTDAILSRAGGSIADFTQHYQTAFRELERVLNFPQSNLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 127 - protein, 410 aa, Artificial Sequence
  Synthetic Phytase (CL00005866)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNDNVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 128 - protein, 410 aa, Artificial Sequence
  Synthetic Phytase (CL00005937)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQLESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 129 - protein, 410 aa, Artificial Sequence
  Synthetic Phytase (CL00006019)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDVSCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 130 - protein, 410 aa, Artificial Sequence
  Synthetic Phytase (CL00006048)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDASCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 131 - protein, 410 aa, Artificial Sequence
  Synthetic Phytase (CL00006049)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNAHVTDAILSRAGGSIADFTGHRQTAFRELERVLNFPQSNLCFNRERQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 132 - protein, 410 aa, Artificial Sequence
  Synthetic Phytase (CL00006063)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFTREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 133 - protein, 410 aa, Artificial Sequence
  Synthetic Phytase (CL00006069)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKSDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 134 - protein, 410 aa, Artificial Sequence
  Synthetic Phytase (CL00006138)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSKLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 135 - protein, 410 aa, Artificial Sequence
  Synthetic Phytase (CL00006139)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNAPVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 136 - protein, 410 aa, Artificial Sequence
  Synthetic Phytase (CL00006142)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFEREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 137 - protein, 410 aa, Artificial Sequence
  Synthetic Phytase (CL00006253)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNAAVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 138 - protein, 410 aa, Artificial Sequence
  Synthetic Phytase (CL00006276)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQNESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 139 - protein, 410 aa, Artificial Sequence
  Synthetic Phytase (CL00006331)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNAHVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 140 - protein, 410 aa, Artificial Sequence
  Synthetic Phytase (CL00006385)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIVAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 141 - protein, 410 aa, Artificial Sequence
  Synthetic Phytase (CL00006672)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPNPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 142 - protein, 410 aa, Artificial Sequence
  Synthetic Phytase (CL00006712)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNELLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 143 - protein, 410 aa, Artificial Sequence
  Synthetic Phytase (CL00006819)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPPPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 144 - protein, 410 aa, Artificial Sequence
  Synthetic Phytase (CL00006870)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLPTPPGEVKLTLAGCEERNAQGMCSLAGFTQIVNEARIPACSL

SEQ ID NO: 145 - protein, 410 aa, Artificial Sequence
  Synthetic Phytase (CL00006874)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEESNAQGMCSLAGFTQIVNEARIPACSL

SEQ ID NO: 146 - protein, 410 aa, Artificial Sequence
  Synthetic Phytase (CL00006875)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNRARIPACSL

SEQ ID NO: 147 - protein, 410 aa, Artificial Sequence
  Synthetic Phytase (CL00006917)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALGLNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 148 - protein, 410 aa, Artificial Sequence
  Synthetic Phytase (CL00007021)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRYSDNSQWIQVSLVFQTLQQMRDKTPLSLNTPPGEVKLTLAGCEERNAQGMCSLAGFTQIVNEARIPACSL

SEQ ID NO: 149 - protein, 410 aa, Artificial Sequence
  Synthetic Phytase (CL00007061)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCSERNAQGMCSLAGFTQIVNEARIPACSL

SEQ ID NO: 150 - protein, 410 aa, Artificial Sequence
  Synthetic Phytase (CL00007067)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEEVNAQGMCSLAGFTQIVNEARIPACSL

SEQ ID NO: 151 - protein, 410 aa, Artificial Sequence
  Synthetic Phytase (CL00007078)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNTARIPACSL

SEQ ID NO: 152 - protein, 410 aa, Artificial Sequence
  Synthetic Phytase (CL00007081)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEETNAQGMCSLAGFTQIVNEARIPACSL

SEQ ID NO: 153 - protein, 410 aa, Artificial Sequence
  Synthetic Phytase (CL00007094)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRVSDNSQWIQVSLVFQTLQQMRDKTPLSLNTPPGEVKLTLAGCEERNAQGMCSLAGFTQIVNEARIPACSL

SEQ ID NO: 154 - protein, 410 aa, Artificial Sequence
  Synthetic Phytase (CL00007097)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALSLNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 155 - protein, 410 aa, Artificial Sequence
  Synthetic Phytase (CL00007111)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNDARIPACSL

SEQ ID NO: 156 - protein, 410 aa, Artificial Sequence
  Synthetic Phytase (CL00007118)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNPARIPACSL

SEQ ID NO: 157 - protein, 410 aa, Artificial Sequence
  Synthetic Phytase (CL00007134)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQEYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 158 - protein, 410 aa, Artificial Sequence
  Synthetic Phytase (CL00007137)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNNARIPACSL

SEQ ID NO: 159 - protein, 410 aa, Artificial Sequence
  Synthetic Phytase (CL00007144)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQRYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 160 - protein, 410 aa, Artificial Sequence
  Synthetic Phytase (CL00007204)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDATPLSLNTPPGEVKLTLAGCEERNAQGMCSLAGFTQIVNEARIPACSL

SEQ ID NO: 161 - protein, 410 aa, Artificial Sequence
  Synthetic Phytase (CL00007207)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLRGCEERNAQGMCSLAGFTQIVNEARIPACSL

SEQ ID NO: 162 - protein, 410 aa, Artificial Sequence
  Synthetic Phytase (CL00007238)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNPPPGEVKLTLAGCEERNAQGMCSLAGFTQIVNEARIPACSL

SEQ ID NO: 163 - protein, 410 aa, Artificial Sequence
  Synthetic Phytase (CL00007303)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQVYGVTLPTSVLFIAGHDTNLANLGGALELNWTLPGQPDNTPPGGELVFERWRRLSDNSQWIQVSLVFQTLQQMRDKTPLSLNTPPGEVKLTLAGCEERNAQGMCSLAGFTQIVNEARIPACSL

SEQ ID NO: 164 - protein, 410 aa, Artificial Sequence
  Synthetic Phytase (CL00007310)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDKTPLSLNTPPGEVKLTLTGCEERNAQGMCSLAGFTQIVNEARIPACSL

SEQ ID NO: 165 - protein, 410 aa, Artificial Sequence
  Synthetic Phytase (CL00007343)
QSEPELKLESVVIVSRHGVRAPTKATQLMQDVTPDAWPTWPVKLGWLTPRGGELIAYLGHYQRQRLVADGLLAKKGCPQPGQVAIIADVDERTRKTGEAFAAGLAPDCAITVHTQADTSSPDPLFNPLKTGVCQLDNANVTDAILSRAGGSIADFTGHRQTAFRELERVLNFPQSNLCFNREKQDESCSLTQALPSELKVSADNVSLTGAVSLASMLTEIFLLQQAQGMPEPGWGRITDSHQWNTLLSLHNAQFYLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVFQTLQQMRDLTPLSLNTPPGEVKLTLAGCEERNAQGMCSLAGFTQIVNEARIPACSL

SEQ ID NO: 166 - protein, 410 aa, Artificial Sequence
  Synthetic Phytase (CL00014748)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPANVTDAILSRAGGSIADFTQHYQTAFRELERVLNFPQSKLCFNREKQNESCSLTQALPSELKVSADNVSLTGAVSLASMLTEIFLLQQAQGMPEPGWGRITDSHQWNTLLSLHNAQFDLLQRTPEVARSRATPLLDLIMAALTPNPPQKQAYGVTLPTSVLFIAGHDTNLANLGGALELNWTLPGQPDNTPPGGELVFERWRRLSDNSQWIQVSLVYQTLQQMRDKTPLSLNTPPGEVKLTLPGCEETNAQGMCSLAGFTQIVNEARIPACSL

SEQ ID NO: 167 - protein, 410 aa, Artificial Sequence
  Synthetic Phytase (CL00014749)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPANVTDAILSRAGGSIADFTQHYQTAFRELERVLNFPQSNLCFNREKQNESCSLTQALPSELKVSADNVSLTGAVSLASMLTEIFLLQQAQGMPEPGWGRITDSHQWNTLLSLHNAQFDLLQRTPEVARSRATPLLDLIMAALTPNPPQKQRYGVTLPTSVLFIAGHDTNLANLGGALGLNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 168 - protein, 410 aa, Artificial Sequence; identical to SEQ ID NO: 9
  Synthetic Phytase (CL00014818 EcPhytase G4P)

SEQ ID NO: 169 - protein, 410 aa, Artificial Sequence
  Synthetic Phytase (CL00015007)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPAHVTDAILSRAGGSIADFTQHYQTAFRELERVLNFPQSKLCFNREKQNESCSLTQALPSELKVSADNVSLTGAVSLASMLTEIFLLQQAQGMPEPGWGRITDSHQWNTLLSLHNAQFDLLQRTPEVARSRATPLLDLIMAALTPNPPQKQRYGVTLPTSVLFIAGHDTNLANLGGALGLNWTLPGQPDNTPPGGELVFERWRRLSDNSQWIQVSLVYQTLQQMRDKTPLSLNTPPGEVKLTLPGCEETNAQGMCSLAGFTQIVNEARIPACSL

SEQ ID NO: 170 - protein, 410 aa, Artificial Sequence
  Synthetic Phytase (CL00015018)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPANVTDAILSRAGGSIADFTQHYQTAFRELERVLNFPQSKLCFNREKQNESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQAYGVTLPTSVLFIAGHDTNLANLGGALELNWTLPGQPDNTPPGGELVFERWRRLSDNSQWIQVSLVYQTLQQMRDATPLSLNTPPGEVKLTLPGCEETNAQGMCSLAGFTQIVNTARIPACSL

SEQ ID NO: 171 - protein, 410 aa, Artificial Sequence
  Synthetic Phytase (CL00015507)
QSEPELKLESVVIVSRHGVRAPTKATQLMQDVTPDAWPTWPVKLGWLTPRGGELVAYLGQYQRQRLVANGLLADKGCPQPGQVAIIADVDERTRKTGEAFAAGLAPDCAITVHTQADTSRPDPLFNPLKTGVCQLDPAAVTDAILSRAGGSIADFTQHYQTAFRELERVLNFPQSKLCFNREKQDESCSLTQALPSELKVSADNVSLTGAVSLASMLTEIFLLQQAQGMPEPGWGRITDSHQWNTLLSLHNAQFDLLQRTPEVARSRATPLLDLIMAALTPHPPQKQRYGVTLPTSVLFIAGHDTNLANLGGALGLNWTLPGQPDNTPPGGELVFERWRRLSDNSQWIQVSLVYQTLQQMRDKTPLSLNTPPGEVKLTLPGCEERNAQGMCSLAGFTQIVNEARIPACSL

SEQ ID NO: 172 - DNA, 1230 bp, Artificial Sequence; identical to SEQ ID NO: 3
  Synthetic Phytase (CL00000004 EcPhytase G1P)

SEQ ID NO: 173 - DNA, 1230 bp, Artificial Sequence
  Synthetic Phytase (CL00000108)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtattaccttgcccacttctctcttgttcattgccggtcacgatactaacttggcaaatctctccggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 174 - DNA, 1230 bp, Artificial Sequence
  Synthetic Phytase (CL00000144)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgatttgctgcagagaactccagaggttgctagatccagagccaccccattgttggacttgatcatggctgctttgactcctcacccacctcaaaagcaagcctacggtgttaccttgcccacttctgtgttgttcattgccggtcacgatactaacttggcaaatctctccggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 175 - DNA, 1230 bp, Artificial Sequence
  Synthetic Phytase (CL00000157)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccagcttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtattaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 176 - DNA, 1230 bp, Artificial Sequence
  Synthetic Phytase (CL00000187)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttctttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 177 - DNA, 1230 bp, Artificial Sequence
  Synthetic Phytase (CL00000216)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtattaccttgcccacttctgtgttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 178 - DNA, 1230 bp, Artificial Sequence
  Synthetic Phytase (CL00000223)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 179 - DNA, 1230 bp, Artificial Sequence
  Synthetic Phytase (CL00000231)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgatttgctgcagagaactccagaggttgctagatccagagccaccccattgttggacttgatcatggctgctttgactcctcacccacctcaaaagcaagcctacggtattaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 180 - DNA, 1230 bp, Artificial Sequence
  Synthetic Phytase (CL00000239)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgttctttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtattaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 181 - DNA, 1230 bp, Artificial Sequence
  Synthetic Phytase (CL00000264)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgtactttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctatttgctgcagagaactccagaggttgctagatccagagccaccccattgttggacttgatcatggctgctttgactcctcacccacctcaaaagcaagcctacggtgttaccttgcccatttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 182 - DNA, 1230 bp, Artificial Sequence
  Synthetic Phytase (CL00000266)
cagagtgagcctgagttgaaactggaatccgttgtcatcgtctctagacatggtgttagagcaccaaccaaggccacccaacttatgaaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctgttattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtgttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 183 - DNA, 1230 bp, Artificial Sequence
  Synthetic Phytase (CL00000313)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttctttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 184 - DNA, 1230 bp, Artificial Sequence
  Synthetic Phytase (CL00000317)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgtactttgactcaagcattaccatctgagttgaaggtctccgccgacaacgtctctttgaccggtgctgtcagcttggcttccatgttgactgaaatctttcttctgcaacaagctcaaggtatgcctgagccagcttggggtagaatcaccgactctcaccaatggaacaccttgttgtccttgcacaacgctcaattcgatttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 185 - DNA, 1230 bp, Artificial Sequence
  Synthetic Phytase (CL00000360)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgtactttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctctgttgttcattgccggtcacgatactaacttggcaaatctctccggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 186 - DNA, 1230 bp, Artificial Sequence
  Synthetic Phytase (CL00000374)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 187 - DNA, 1230 bp, Artificial Sequence
  Synthetic Phytase (CL00000387)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacacagacagactgccttcagagagttggaaagagttcttaacttcccacaatccaacttgtgctttaaccgtgagaagcaagacgaatcctgttctttgactcaagcattaccatctgagttgaaggtctccgccgacaacgtctctttgaccggtgctgtcagcttggcttccatgttgactgaaatctttcttctgcaacaagctcaaggtatgcctgagccagcttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 188 - DNA, 1230 bp, Artificial Sequence
  Synthetic Phytase (CL00000391)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtattaccttgcccacttctctgttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 189 - DNA, 1230 bp, Artificial Sequence
  Synthetic Phytase (CL00000408)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 190 - DNA, 1230 bp, Artificial Sequence
  Synthetic Phytase (CL00000420)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 191 - DNA, 1230 bp, Artificial Sequence; identical to SEQ ID NO: 6
  Synthetic Phytase (CL00000430 EcPhytase G2P)

SEQ ID NO: 192 - DNA, 1230 bp, Artificial Sequence
  Synthetic Phytase (CL00000432)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctctgttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 193 - DNA, 1230 bp, Artificial Sequence
  Synthetic Phytase (CL00000528)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctctcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 194 - DNA, 1230 bp, Artificial Sequence
  Synthetic Phytase (CL00000565)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtgttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 195 - DNA, 1230 bp, Artificial Sequence
  Synthetic Phytase (CL00000588)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctgttattgctgacgtcgacgaaagaacccgtaagacaggtgaagccttcttggccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcactaccagactgccttcagagagttggaaagagttcttaacttcccacaatccaacttgtgctttaaccgtgagaagcaagacgaatcctgtactttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgatttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 196 - DNA, 1230 bp, Artificial Sequence
  Synthetic Phytase (CL00000605)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttgaggacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 197 - DNA, 1230 bp, Artificial Sequence
  Synthetic Phytase (CL00000624)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttggggacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 198 - DNA, 1230 bp, Artificial Sequence
  Synthetic Phytase (CL00000625)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgcggagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 199 - DNA, 1230 bp, Artificial Sequence
  Synthetic Phytase (CL00000647)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttgcggacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 200 - DNA, 1230 bp, Artificial Sequence
  Synthetic Phytase (CL00000663)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggactctgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 201 - DNA, 1230 bp, Artificial Sequence
  Synthetic Phytase (CL00000690)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccaatcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 202 - DNA, 1230 bp, Artificial Sequence
  Synthetic Phytase (CL00000715)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttcgggacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 203 - DNA, 1230 bp, Artificial Sequence
  Synthetic Phytase (CL00000716)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccttcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 204 - DNA, 1230 bp, Artificial Sequence
  Synthetic Phytase (CL00000721)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccggcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 205 - DNA, 1230 bp, Artificial Sequence
  Synthetic Phytase (CL00000774)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccgctcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 206 - DNA, 1230 bp, Artificial Sequence
  Synthetic Phytase (CL00000835)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccggctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 207 - DNA, 1230 bp, Artificial Sequence
  Synthetic Phytase (CL00000872)
tcgagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 208 - DNA, 1230 bp, Artificial Sequence
  Synthetic Phytase (CL00001018)
gttagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 209 - DNA, 1230 bp, Artificial Sequence
  Synthetic Phytase (CL00001019)
cagagtgagcctgagttgaaactggaatccgttgtcatcgtctctagacatggtgttagagcaccaaccaaggccacccaacttatgcaagatgtcaccccagacaagtggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 210 - DNA, 1230 bp, Artificial Sequence
  Synthetic Phytase (CL00001052)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 211 - DNA, 1230 bp, Artificial Sequence
  Synthetic Phytase (CL00001132)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctcgtccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 212 - DNA, 1230 bp, Artificial Sequence
  Synthetic Phytase (CL00001154)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgaccgttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 213 - DNA, 1230 bp, Artificial Sequence
  Synthetic Phytase (CL00001170)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgatattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 214 - DNA, 1230 bp, Artificial Sequence
  Synthetic Phytase (CL00001177)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccattgccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 215 - DNA, 1230 bp, Artificial Sequence
  Synthetic Phytase (CL00001243)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggataagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 216 - DNA, 1230 bp, Artificial Sequence
  Synthetic Phytase (CL00001286)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgactcgtcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 217 - DNA, 1230 bp, Artificial Sequence
  Synthetic Phytase (CL00001294)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaatatgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 218 - DNA, 1230 bp, Artificial Sequence
  Synthetic Phytase (CL00001316)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 219 - DNA, 1230 bp, Artificial Sequence
  Synthetic Phytase (CL00001342)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgagattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 220 - DNA, 1230 bp, Artificial Sequence
  Synthetic Phytase (CL00001352)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaaccggacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 221 - DNA, 1230 bp, Artificial Sequence
  Synthetic Phytase (CL00001366)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 222 - DNA, 1230 bp, Artificial Sequence
  Synthetic Phytase (CL00001389)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcagtaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 223 - DNA, 1230 bp, Artificial Sequence
  Synthetic Phytase (CL00001394)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccccgaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 224 - DNA, 1230 bp, Artificial Sequence
  Synthetic Phytase (CL00001416)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggttcttaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 225 - DNA, 1230 bp, Artificial Sequence
  Synthetic Phytase (CL00001428)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaacgtgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 226 - DNA, 1230 bp, Artificial Sequence
  Synthetic Phytase (CL00001446)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattcaggttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 227 - DNA, 1230 bp, Artificial Sequence
  Synthetic Phytase (CL00001522)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgttaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 228 - DNA, 1230 bp, Artificial Sequence
  Synthetic Phytase (CL00001543)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgttttattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 229 - DNA, 1230 bp, Artificial Sequence
  Synthetic Phytase (CL00001591)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtccgattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 230 - DNA, 1230 bp, Artificial Sequence
  Synthetic Phytase (CL00001592)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccatttccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 231 - DNA, 1230 bp, Artificial Sequence
  Synthetic Phytase (CL00001593)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaaccataacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 232 - DNA, 1230 bp, Artificial Sequence
  Synthetic Phytase (CL00001608)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccaatggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 233 - DNA, 1230 bp, Artificial Sequence
  Synthetic Phytase (CL00004927)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggttcttaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttcttctccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 234 - DNA, 1230 bp, Artificial Sequence
  Synthetic Phytase (CL00004928)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggactctgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 235 - DNA, 1230 bp, Artificial Sequence
  Synthetic Phytase (CL00004930)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 236 - DNA, 1230 bp, Artificial Sequence
  Synthetic Phytase (CL00004936)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 237 - DNA, 1230 bp, Artificial Sequence
  Synthetic Phytase (CL00004938)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattgatgttcacacccaagctgacacttcttctccagatccattgttcaaccctttgaagactggtgtttgccaattggacaacgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 238 - DNA, 1230 bp, Artificial Sequence
  Synthetic Phytase (CL00004940)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggactctgttaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 239 - DNA, 1230 bp, Artificial Sequence
  Synthetic Phytase (CL00004948)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccgacggattgttggccccaaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggactctgctaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 240 - DNA, 1230 bp, Artificial Sequence
  Synthetic Phytase (CL00004951)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccaacggattgttggccccaaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 241 - DNA, 1230 bp, Artificial Sequence
  Synthetic Phytase (CL00004954)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccgacggattgttggccccaaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 242 - DNA, 1230 bp, Artificial Sequence
  Synthetic Phytase (CL00004962)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 243 - DNA, 1230 bp, Artificial Sequence
  Synthetic Phytase (CL00004963)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcaataccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 244 - DNA, 1230 bp, Artificial Sequence
  Synthetic Phytase (CL00004967)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 245 - DNA, 1230 bp, Artificial Sequence
  Synthetic Phytase (CL00004970)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 246 - DNA, 1230 bp, Artificial Sequence
  Synthetic Phytase (CL00004976)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcaataccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggactctgttaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 247 - DNA, 1230 bp, Artificial Sequence
  Synthetic Phytase (CL00004977)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccgctcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 248 - DNA, 1230 bp, Artificial Sequence
  Synthetic Phytase (CL00004979)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcaataccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 249 - DNA, 1230 bp, Artificial Sequence
  Synthetic Phytase (CL00004981)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 250 - DNA, 1230 bp, Artificial Sequence
  Synthetic Phytase (CL00004983)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagctaacgttgaagacgctatcttgtccagagctggaggatccattgctgacttcaccgctcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 251 - DNA, 1230 bp, Artificial Sequence
  Synthetic Phytase (CL00004990)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagttaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 252 - DNA, 1230 bp, Artificial Sequence
  Synthetic Phytase (CL00004994)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcaataccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 253 - DNA, 1230 bp, Artificial Sequence
  Synthetic Phytase (CL00004998)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 254 - DNA, 1230 bp, Artificial Sequence
  Synthetic Phytase (CL00005001)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccccaaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 255 - DNA, 1230 bp, Artificial Sequence
  Synthetic Phytase (CL00005002)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 256 - DNA, 1230 bp, Artificial Sequence
  Synthetic Phytase (CL00005012)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 257 - DNA, 1230 bp, Artificial Sequence
  Synthetic Phytase (CL00005013)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 258 - DNA, 1230 bp, Artificial Sequence; identical to SEQ ID NO: 8
  Synthetic Phytase (CL00005023 EcPhytase G3P)

SEQ ID NO: 259 - DNA, 1230 bp, Artificial Sequence
  Synthetic Phytase (CL00005041)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 260 - DNA, 1230 bp, Artificial Sequence
  Synthetic Phytase (CL00005054)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccccaaagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 261 - DNA, 1230 bp, Artificial Sequence
  Synthetic Phytase (CL00005064)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 262 - DNA, 1230 bp, Artificial Sequence
  Synthetic Phytase (CL00005080)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 263 - DNA, 1230 bp, Artificial Sequence
  Synthetic Phytase (CL00005081)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 264 - DNA, 1230 bp, Artificial Sequence
  Synthetic Phytase (CL00005083)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggttcttaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 265 - DNA, 1230 bp, Artificial Sequence
  Synthetic Phytase (CL00005086)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggttcttaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggactctgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 266 - DNA, 1230 bp, Artificial Sequence
  Synthetic Phytase (CL00005181)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacccagttaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 267 - DNA, 1230 bp, Artificial Sequence
  Synthetic Phytase (CL00005230)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccttgcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 268 - DNA, 1230 bp, Artificial Sequence
  Synthetic Phytase (CL00005241)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 269 - DNA, 1230 bp, Artificial Sequence
  Synthetic Phytase (CL00005248)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 270 - DNA, 1230 bp, Artificial Sequence
  Synthetic Phytase (CL00005267)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 271 - DNA, 1230 bp, Artificial Sequence
  Synthetic Phytase (CL00005313)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggactctgttaacgttactgacgctatcttgtccagagctggaggatccattgctgacttcaccttgcactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 272 - DNA, 1230 bp, Artificial Sequence
  Synthetic Phytase (CL00005417)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccaacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttgctgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 273 - DNA, 1230 bp, Artificial Sequence
  Synthetic Phytase (CL00005517)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggttcttaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 274 - DNA, 1230 bp, Artificial Sequence
  Synthetic Phytase (CL00005529)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 275 - DNA, 1230 bp, Artificial Sequence
  Synthetic Phytase (CL00005540)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 276 - DNA, 1230 bp, Artificial Sequence
  Synthetic Phytase (CL00005550)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggttcttaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 277 - DNA, 1230 bp, Artificial Sequence
  Synthetic Phytase (CL00005552)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 278 - DNA, 1230 bp, Artificial Sequence
  Synthetic Phytase (CL00005563)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggttcttaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 279 - DNA, 1230 bp, Artificial Sequence
  Synthetic Phytase (CL00005570)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 280 - DNA, 1230 bp, Artificial Sequence
  Synthetic Phytase (CL00005572)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattgatgttcacacccaagctgacacttcttctccagatccattgttcaaccctttgaagactggtgtttgccaattggacaacgctaacgttgaagacgctatcttgtccagagctggaggatccattgctgacttcaccaaccactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 281 - DNA, 1230 bp, Artificial Sequence
  Synthetic Phytase (CL00005573)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggttcttaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttgaagacgctatcttgtccagagctggaggatccattgctgacttcaccaaccactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 282 - DNA, 1230 bp, Artificial Sequence
  Synthetic Phytase (CL00005579)
cagagtgagcctgagttgaaactggaatccgttgtcatcgtctctagacatggtgttagagcaccaaccaaggccacccaacttatgcaagatgtcaccccagacgcttggccagattggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 283 - DNA, 1230 bp, Artificial Sequence
  Synthetic Phytase (CL00005587)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 284 - DNA, 1230 bp, Artificial Sequence
  Synthetic Phytase (CL00005590)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttactgacgctatcttgtccagagctggaggatccattgctgacttcaccaaccactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 285 - DNA, 1230 bp, Artificial Sequence
  Synthetic Phytase (CL00005621)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 286 - DNA, 1230 bp, Artificial Sequence
  Synthetic Phytase (CL00005625)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattgatgttcacacccaagctgacacttctagaccagatccattgttcaaccctttgaagactggtgtttgccaattggacaacgctaacgttgaagacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 287 - DNA, 1230 bp, Artificial Sequence
  Synthetic Phytase (CL00005677)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggttcttaccaaagacagcatcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcacccaacactaccagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 288 - DNA, 1230 bp, Artificial Sequence
  Synthetic Phytase (CL00005866)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgataacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 289 - DNA, 1230 bp, Artificial Sequence
  Synthetic Phytase (CL00005937)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaacttgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 290 - DNA, 1230 bp, Artificial Sequence
  Synthetic Phytase (CL00006019)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgtttcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 291 - DNA, 1230 bp, Artificial Sequence
  Synthetic Phytase (CL00006048)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgcttcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 292 - DNA, 1230 bp, Artificial Sequence
  Synthetic Phytase (CL00006049)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctcacgttactgacgctatcttgtccagagctggaggatccattgctgacttcaccggtcacagacagactgccttcagagagttggaaagagttcttaacttcccacaatccaacttgtgctttaaccgtgagaggcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 293 - DNA, 1230 bp, Artificial Sequence
  Synthetic Phytase (CL00006063)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttactcgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 294 - DNA, 1230 bp, Artificial Sequence
  Synthetic Phytase (CL00006069)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagtcggacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 295 - DNA, 1230 bp, Artificial Sequence
  Synthetic Phytase (CL00006138)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaagttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 296 - DNA, 1168 bp, Artificial Sequence
  Synthetic Phytase (CL00006139)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctccggttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggta

SEQ ID NO: 297 - DNA, 1230 bp, Artificial Sequence
  Synthetic Phytase (CL00006142)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttgagcgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 298 - DNA, 1230 bp, Artificial Sequence
  Synthetic Phytase (CL00006253)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctgctgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 299 - DNA, 1230 bp, Artificial Sequence
  Synthetic Phytase (CL00006276)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaaaatgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 300 - DNA, 1230 bp, Artificial Sequence
  Synthetic Phytase (CL00006331)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctcatgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 301 - DNA, 1230 bp, Artificial Sequence
  Synthetic Phytase (CL00006385)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcgttgctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 302 - DNA, 1230 bp, Artificial Sequence
  Synthetic Phytase (CL00006672)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctaatccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 303 - DNA, 1230 bp, Artificial Sequence
  Synthetic Phytase (CL00006712)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacgagttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 304 - DNA, 1230 bp, Artificial Sequence
  Synthetic Phytase (CL00006819)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctccgccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 305 - DNA, 1230 bp, Artificial Sequence
  Synthetic Phytase (CL00006870)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgcctacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 306 - DNA, 1230 bp, Artificial Sequence
  Synthetic Phytase (CL00006874)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagtcgaatgctcagggtatgtgttccttggctggtttcactcaaatcgttaacgaagctagaatcccagcttgttccttg

SEQ ID NO: 307 - DNA, 1230 bp, Artificial Sequence
  Synthetic Phytase (CL00006875)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacagggctagaatcccagcttgttccttg

SEQ ID NO: 308 - DNA, 1230 bp, Artificial Sequence
  Synthetic Phytase (CL00006917)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttgggtttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 309 - DNA, 1230 bp, Artificial Sequence
  Synthetic Phytase (CL00007021)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagatattctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 310 - DNA, 1230 bp, Artificial Sequence
  Synthetic Phytase (CL00007061)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgttcggagagaaatgctcagggtatgtgttccttggctggtttcactcaaatcgttaacgaagctagaatcccagcttgttccttg

SEQ ID NO: 311 - DNA, 1230 bp, Artificial Sequence
  Synthetic Phytase (CL00007067)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagaggtgaatgctcagggtatgtgttccttggctggtttcactcaaatcgttaacgaagctagaatcccagcttgttccttg

SEQ ID NO: 312 - DNA, 1230 bp, Artificial Sequence
  Synthetic Phytase (CL00007078)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacacggctagaatcccagcttgttccttg

SEQ ID NO: 313 - DNA, 1230 bp, Artificial Sequence
  Synthetic Phytase (CL00007081)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagactaatgctcagggtatgtgttccttggctggtttcactcaaatcgttaacgaagctagaatcccagcttgttccttg

SEQ ID NO: 314 - DNA, 1230 bp, Artificial Sequence
  Synthetic Phytase (CL00007094)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagagtgtctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 315 - DNA, 1230 bp, Artificial Sequence
  Synthetic Phytase (CL00007097)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttgagtttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 316 - DNA, 1230 bp, Artificial Sequence
  Synthetic Phytase (CL00007111)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgatgctagaatcccagcttgttccttg

SEQ ID NO: 317 - DNA, 1230 bp, Artificial Sequence
  Synthetic Phytase (CL00007118)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacccggctagaatcccagcttgttccttg

SEQ ID NO: 318 - DNA, 1230 bp, Artificial Sequence
  Synthetic Phytase (CL00007134)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagagtacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 319 - DNA, 1230 bp, Artificial Sequence
  Synthetic Phytase (CL00007137)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacaatgctagaatcccagcttgttccttg

SEQ ID NO: 320 - DNA, 1230 bp, Artificial Sequence
  Synthetic Phytase (CL00007144)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaaaggtacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 321 - DNA, 1230 bp, Artificial Sequence
  Synthetic Phytase (CL00007204)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacgcgactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 322 - DNA, 1230 bp, Artificial Sequence
  Synthetic Phytase (CL00007207)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttgcggggatgtgaagagagaaatgctcagggtatgtgttccttggctggtttcactcaaatcgttaacgaagctagaatcccagcttgttccttg

SEQ ID NO: 323 - DNA, 1230 bp, Artificial Sequence
  Synthetic Phytase (CL00007238)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacccgcctccaggagaagtcaaattgaccttggctggatgtgaagagagaaatgctcagggtatgtgttccttggctggtttcactcaaatcgttaacgaagctagaatcccagcttgttccttg

SEQ ID NO: 324 - DNA, 1230 bp, Artificial Sequence
  Synthetic Phytase (CL00007303)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagtgtacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 325 - DNA, 1230 bp, Artificial Sequence
  Synthetic Phytase (CL00007310)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacaagactccactgtctttgaacacgcctccaggagaagtcaaattgaccttgacgggatgtgaagagagaaatgctcagggtatgtgttccttggctggtttcactcaaatcgttaacgaagctagaatcccagcttgttccttg

SEQ ID NO: 326 - DNA, 1230 bp, Artificial Sequence
  Synthetic Phytase (CL00007343)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcattgcttacttgggtcactaccaaagacagcgtcttgttgccgacggattgttggccaagaagggttgtccacaaccaggtcaagtagctattattgctgacgtcgacgaaagaacccgtaagacaggtgaagccttcgccgccggtcttgctcctgactgtgccattaccgttcacacccaagctgacacttcttctccagatccattgttcaaccctttgaagactggtgtttgccaattggacaacgctaacgttactgacgctatcttgtccagagctggaggatccattgctgacttcaccggtcacagacagactgccttcagagagttggaaagagttcttaacttcccacaatccaacttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattctacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtcttccaaactttgcagcagatgagagacttgactccactgtctttgaacacgcctccaggagaagtcaaattgaccttggctggatgtgaagagagaaatgctcagggtatgtgttccttggctggtttcactcaaatcgttaacgaagctagaatcccagcttgttccttg

SEQ ID NO: 327 - DNA, 1230 bp, Artificial Sequence
  Synthetic Phytase (CL00014748)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaagttgtgctttaaccgtgagaagcaaaacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctaacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagactaatgctcagggtatgtgttccttggctggtttcactcaaatcgttaacgaagctagaatcccagcttgttccttg

SEQ ID NO: 328 - DNA, 1230 bp, Artificial Sequence
  Synthetic Phytase (CL00014749)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaacttgtgctttaaccgtgagaagcaaaacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctaacccacctcaaaagcaaagatacggtgttaccttgcccacttctgtcttgttcattgccggtcacgatactaacttggcaaatctcggcggtgctttgggtttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

SEQ ID NO: 329 - DNA, 1230 bp, Artificial Sequence; identical to SEQ ID NO: 10
  Synthetic Phytase (CL00014818 EcPhytase G4P)

SEQ ID NO: 330 - DNA, 1230 bp, Artificial Sequence
  Synthetic Phytase (CL00015007)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctcatgttactgacgctatcttgtccagagctggaggatccattgctgacttcacccaacactaccagactgccttcagagagttggaaagagttcttaacttcccacaatccaagttgtgctttaaccgtgagaagcaaaacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctaacccacctcaaaagcaaagatacggtgttaccttgcccacttctgtcttgttcattgccggtcacgatactaacttggcaaatctcggcggtgctttgggtttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagactaatgctcagggtatgtgttccttggctggtttcactcaaatcgttaacgaagctagaatcccagcttgttccttg

SEQ ID NO: 331 - DNA, 1230 bp, Artificial Sequence
  Synthetic Phytase (CL00015018)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctaacgttactgacgctatcttgtccagagctggaggatccattgctgacttcacccaacactaccagactgccttcagagagttggaaagagttcttaacttcccacaatccaagttgtgctttaaccgtgagaagcaaaacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaagcctacggtgttaccttgcccacttctgtcttgttcattgccggtcacgatactaacttggcaaatctcggcggtgctttggagttgaactggactcttcctggtcaacctgataacactccaccaggtggtgagctcgttttcgaaagatggcgtagactatctgataactctcaatggattcaggtttcgttggtctaccaaactttgcagcagatgagagacgctactccactgtctttgaacacgcctccaggagaagtcaaattgaccttgcctggatgtgaagagactaatgctcagggtatgtgttccttggctggtttcactcaaatcgttaacactgctagaatcccagcttgttccttg

SEQ ID NO: 332 - DNA, 1230 bp, Artificial Sequence
  Synthetic Phytase (CL00015507)
cagagtgagcctgagttgaaactggaatccgttgtcatcgtctctagacatggtgttagagcaccaaccaaggccacccaacttatgcaagatgtcaccccagacgcttggccaacctggccagtcaagctgggttggttgacacctagaggtggtgagctcgttgcttacttgggtcaataccaaagacagcgtcttgttgccaacggattgttggccgataagggttgtccacaaccaggtcaagtagctattattgctgacgtcgacgaaagaacccgtaagacaggtgaagccttcgccgccggtcttgctcctgactgtgccattaccgttcacacccaagctgacacttctagaccagatccattgttcaaccctttgaagactggtgtttgccaattggacccagctgctgttactgacgctatcttgtccagagctggaggatccattgctgacttcacccaacactaccagactgccttcagagagttggaaagagttcttaacttcccacaatccaagttgtgctttaaccgtgagaagcaagacgaatcctgttccttgactcaagcattaccatctgagttgaaggtctccgccgacaacgtctctttgaccggtgctgtcagcttggcttccatgttgactgaaatctttcttctgcaacaagctcaaggtatgcctgagccaggttggggtagaatcaccgactctcaccaatggaacaccttgttgtccttgcacaacgctcaattcgacttgctgcagagaactccagaggttgctagatccagagccaccccattgttggacttgatcatggctgctttgactcctcacccacctcaaaagcaaagatacggtgttaccttgcccacttctgtcttgttcattgccggtcacgatactaacttggcaaatctcggcggtgctttgggtttgaactggactcttcctggtcaacctgataacactccaccaggtggtgagctcgttttcgaaagatggcgtagactatctgataactctcaatggattcaggtttcgttggtctaccaaactttgcagcagatgagagacaagactccactgtctttgaacacgcctccaggagaagtcaaattgaccttgcctggatgtgaagagagaaatgctcagggtatgtgttccttggctggtttcactcaaatcgttaacgaagctagaatcccagcttgttccttg

We claim:

1. A composition comprising a variant phytase enzyme comprising amino acid substitutions of Y255D and F354Y and at least one further amino acid substitution as compared to SEQ ID NO:1, wherein said further amino acid substitution is selected from the group consisting of Q1S, Q1V, Q1N, Q30K, A36K, T39D, I55V, H60S, H60Q, R65H, D69N, A73D, A73E, K74D, K74P, K74L, Q79L, Q79R, Q79A, Q79G, Q79F, I85V, A101L, A109D, A109E, A109G, A109F, A109P, T111S, T111D, T111Q, A116Y, A116P, A116R, A116S, T118R, T118S, S120R, N137S, N137P, A138V, A138H, A138D, A138P, N139P, N139A, N139H, T141E, T141G, T141A, T141R, S146R, G157Q, G157N, G157L, G157R, G157A, N176K, N180T, N180E, K183R, Q1845, D185N, D185L, E186V, E186A, S189T, G233A, T245E, M276V, H282N, H282P, A288E, A288R, A288V, V291I, T295I, V297L, G311S, E315G, E315S, L341Y, L341V, K363A, K363L, N369P, T370P, A380R, A380T, E383S, R385S, R385V, R385T, E402R, E402T, E402D, E402P and E402N; and wherein said variant phytase enzyme has at least 90% sequence identity to SEQ ID NO: 1 and has phytase activity.

2. The composition according to claim 1 wherein said variant phytase comprises the amino acid substitutions I55V/G157Q/R159Y/Y255D/F354Y/A380P and has at least 95% sequence identity to SEQ ID NO:5, and wherein said variant phytase has phytase activity.

3. The composition according to claim 1 wherein said variant phytase comprises the amino acid substitutions I55V/G157Q/R159Y/Y255D/F354Y/A380P/H60Q/D69N/ K74D/S120R/N137P and has at least 95% sequence identity to SEQ ID NO:7, and wherein said variant phytase has phytase activity.

4. The composition according to claim 1 wherein said variant phytase comprises the amino acid substitutions I55V/G157Q/R159Y/Y255D/F354Y/A380P/H60Q/D69N/ K74D/S120R/N137P/N139A/N176K/D185N/E402D and has at least 95% sequence identity to SEQ ID NO:9, and wherein said variant phytase has phytase activity.

5. A composition according to claim 1 wherein said variant phytase enzyme has an amino acid substitution set selected from the group consisting of I55V/Y255D/G311S/ F354Y, I55V/I85V/Y255D/V291I/F354Y, I55V/I85V/ S189T/G233A/Y255D/F354Y/A380P, I55V/G157Q/ Y255D/V291I/V297L/F354Y, I55V/G157Q/R159Y/ Y255D/F354Y/A380P, I55V/I85V/G157Q/G233A/Y255D/ V297L/F354Y, I55V/A101L/G157Q/Y255D/F354Y, I55V/ I85V/A101L/R159Y/S189T/Y255D/F354Y, I55V/G157Q/ R159Y/Y255D/F354Y/A380P/H60S/D69N/T111D/N137P, I55V/G157Q/R159Y/Y255D/F354Y/A380P/T39D/N1375/ T141A, I55V/G157Q/R159Y/Y255D/F354Y/A380P/ H60Q/D69N/N137P/A138V, I55V/G157Q/R159Y/Y255D/ F354Y/A380P/T39D/D69N/K74D/N137P/A138V/T141E, I55V/G157Q/R159Y/Y255D/F354Y/A380P/K74D/T111D/ T141A, I55V/G157Q/R159Y/Y255D/F354Y/A380P/ N1375/A138V/T141E, I55V/G157Q/R159Y/Y255D/ F354Y/A380P/H60Q/K74P/N137S/T141E, I55V/G157Q/ R159Y/Y255D/F354Y/A380P/D69N/K74P, I55V/G157Q/ R159Y/Y255D/F354Y/A380P/H60Q/K74P, I55V/G157Q/ R159Y/Y255D/F354Y/A380P/T39D/T111D/S120R, I55V/ G157Q/R159Y/Y255D/F354Y/A380P/T39D/H60Q/K74D/ T111D/S120R, I55V/G157Q/R159Y/Y255D/F354Y/ A380P/T39D/D69N, I55V/G157Q/R159Y/Y255D/F354Y/ A380P/D69N/K74D, I55V/G157Q/R159Y/Y255D/F354Y/

A380P/T39D/H60Q/D69N/N137S/A138V, I55V/G157Q/R159Y/Y255D/F354Y/A380P/T39D/K74D/Q157A, I55V/G157Q/R159Y/Y255D/F354Y/A380P/T39D/H60Q/K74D/N137P/T141A, I55V/G157Q/R159Y/Y255D/F354Y/A380P/K74D, I55V/G157Q/R159Y/Y255D/F354Y/A380P/T39D/D69N/N137P/T141E/Q157A, I55V/G157Q/R159Y/Y255D/F354Y/A380P/S120R/N137P/A138V, I55V/G157Q/R159Y/Y255D/F354Y/A380P/T39D/H60Q, I55V/G157Q/R159Y/Y255D/F354Y/A380P/K74D/T141A, I55V/G157Q/R159Y/Y255D/F354Y/A380P/K74P, I55V/G157Q/R159Y/Y255D/F354Y/A380P/N137P/A138V, I55V/G157Q/R159Y/Y255D/F354Y/A380P/H60Q/D69N, I55V/G157Q/R159Y/Y255D/F354Y/A380P/T39D/D69N/K74D, I55V/G157Q/R159Y/Y255D/F354Y/A380P/H60Q/D69N/K74D/S120R/N137P, I55V/G157Q/R159Y/Y255D/F354Y/A380P/D69N/N137P/A138V/T141E, I55V/G157Q/R159Y/Y255D/F354Y/A380P/T39D/D69N/K74P/T111D/S120R/T141A, I55V/G157Q/R159Y/Y255D/F354Y/A380P/N137P/T141A, I55V/G157Q/R159Y/Y255D/F354Y/A380P/N137P/A138V/T141E, I55V/G157Q/R159Y/Y255D/F354Y/A380P/T39D/K74D, I55V/G157Q/R159Y/Y255D/F354Y/A380P/T39D/H60S/T111D/S120R, I55V/G157Q/R159Y/Y255D/F354Y/A380P/T39D/H60S/D69N/S120R/N137S/T141A, I55V/G157Q/R159Y/Y255D/F354Y/A380P/H60Q/N137P/A138V/T141A, I55V/G157Q/R159Y/Y255D/F354Y/A380P/Q157L, I55V/G157Q/R159Y/Y255D/F354Y/A380P/S120R/N137P, I55V/G157Q/R159Y/Y255D/F354Y/A380P/H60Q, I55V/G157Q/R159Y/Y255D/F354Y/A380P/S120R, I55V/G157Q/R159Y/Y255D/F354Y/A380P/S120R/N137S/A138V/Q157L, I55V/G157Q/R159Y/Y255D/F354Y/A380P/H60S/K74Y/S120R/A138V, I55V/G157Q/R159Y/Y255D/F354Y/A380P/T39D/D69N/S120R/T141A, I55V/G157Q/R159Y/Y255D/F354Y/A380P/H60S, I55V/G157Q/R159Y/Y255D/F354Y/A380P/T39D/S120R, I55V/G157Q/R159Y/Y255D/F354Y/A380P/T39D, I55V/G157Q/R159Y/Y255D/F354Y/A380P/H60 S/K74D, I55V/G157Q/R159Y/Y255D/F354Y/A380P/T39D/T111D, I55V/G157Q/R159Y/Y255D/F354Y/A380P/T39D/H60S, I55V/G157Q/R159Y/Y255D/F354Y/A380P/T39D/K74D/T141E, I55V/G157Q/R159Y/Y255D/F354Y/A380P/K74D/T111D/T141E/Q157N, I55V/G157Q/R159Y/Y255D/F354Y/A380P/H60S/K74D/T111D/S120R/T141E/Q157N, I55V/G157Q/R159Y/Y255D/F354Y/A380P/T39D/K74D/S120R/T141E, I55V/G157Q/R159Y/Y255D/F354Y/A380P/T141E, I55V/G157Q/R159Y/Y255D/F354Y/A380P/K74D/S120R/Q157N, I55V/G157Q/R159Y/Y255D/F354Y/A380P/K74D/S120R, I55V/G157Q/R159Y/Y255D/F354Y/A380P/T111D/S120R/T141E, I55V/G157Q/R159Y/Y255D/F354Y/A380P/H60S/R65H, I55V/H60Q/D69N/K74D/S120R/N137P/G157Q/R159Y/Y255D/F354Y/A380P/N139A/N176K/D185N/E402D, I55V/H60Q/D69N/K74D/S120R/N137P/G157Q/R159Y/Y255D/F354Y/A380P/N176K/D185N/H282N/R385T, I55V/H60Q/D69N/K74D/S120R/N137P/G157Q/R159Y/Y255D/F354Y/A380P/N176K/D185N/K363A/R385T/E402T, I55V/H60Q/D69N/K74D/S120R/N137P/G157Q/R159Y/Y255D/F354Y/A380P/N139H/N176K/D185N/H282N/A288R/E315G/R385T, I55V/H60Q/D69N/K74D/S120R/N137P/G157Q/R159Y/Y255D/F354Y/A380P/N139A/N176K/A288R/E315G, and I55V/H60Q/D69N/K74D/S120R/N137P/G157Q/R159Y/Y255D/F354Y/A380P/D185N/H282N/A288R/E315G.

6. The composition according to claim 1 further comprising animal feed.

* * * * *